US010975420B2

(12) United States Patent
Shapiro et al.

(10) Patent No.: US 10,975,420 B2
(45) Date of Patent: Apr. 13, 2021

(54) THERMAL BIOSWITCHES AND RELATED GENETIC CIRCUITS, VECTORS, CELLS, COMPOSITIONS, METHODS AND SYSTEMS

(71) Applicant: CALIFORNIA INSTITUTE OF TECHNOLOGY, Pasadena, CA (US)

(72) Inventors: Mikhail G. Shapiro, Los Angeles, CA (US); Dan I. Piraner, Pasadena, CA (US); Mohamad H. Abedi, Azusa, CA (US); Brittany Moser, Irvine, CA (US); Audrey Lee-Gosselin, Pasadena, CA (US)

(73) Assignee: CALIFORNIA INSTITUTE OF TECHNOLOGY, Pasadena, CA (US)

( * ) Notice: Subject to any disclaimer, the term of this patent is extended or adjusted under 35 U.S.C. 154(b) by 0 days.

(21) Appl. No.: 15/384,254

(22) Filed: Dec. 19, 2016

(65) Prior Publication Data
US 2017/0298425 A1     Oct. 19, 2017

Related U.S. Application Data

(60) Provisional application No. 62/269,715, filed on Dec. 18, 2015.

(51) Int. Cl.
*C12Q 1/68* (2018.01)
*C12Q 1/6825* (2018.01)
*B01L 7/00* (2006.01)
*C12N 15/63* (2006.01)
*C12N 15/10* (2006.01)
*C12N 15/82* (2006.01)
*G01N 33/53* (2006.01)
*C12N 15/00* (2006.01)

(52) U.S. Cl.
CPC .......... *C12Q 1/6825* (2013.01); *B01L 7/52* (2013.01); *C12N 15/1055* (2013.01); *C12N 15/63* (2013.01); *C12N 15/8217* (2013.01); *G01N 33/53* (2013.01); *C12N 15/00* (2013.01); *C12Q 2525/30* (2013.01)

(58) Field of Classification Search
None
See application file for complete search history.

(56) References Cited

U.S. PATENT DOCUMENTS

| | | | | |
|---|---|---|---|---|
| 9,284,562 B2 * | 3/2016 | Collins | ............... | C12N 15/635 |
| 2012/0252077 A1 * | 10/2012 | Figge | ................. | C12P 13/12 435/113 |
| 2013/0089903 A1 * | 4/2013 | Dischert | .............. | C12N 15/635 435/146 |
| 2015/0191735 A1 * | 7/2015 | Williams | .............. | C12N 15/85 435/69.3 |
| 2016/0312215 A1 * | 10/2016 | Murray | .............. | C12N 15/1093 |
| 2016/0333326 A1 * | 11/2016 | Falb | ................. | C12N 9/1029 |
| 2017/0232043 A1 * | 8/2017 | Falb | ................. | A61K 35/74 424/93.2 |
| 2017/0253862 A1 * | 9/2017 | Falb | ................. | C12N 9/1029 |
| 2018/0004890 A1 * | 1/2018 | Ganjam | .............. | C12Q 1/6816 |

FOREIGN PATENT DOCUMENTS

| | | |
|---|---|---|
| WO | 2011/130540 A1 | 10/2011 |
| WO | 2012/088461 A2 | 6/2012 |
| WO | 2016/098078 A2 | 6/2016 |

OTHER PUBLICATIONS

Ganguly et al in "A Point Mutation at the C-Terminal Half of the Repressor of Temperate Mycobacteriophge L1 Affects Its Binding to the Operator DNA" (Journal of Biochemistry and Molecular Biology, vol. 37, No. 6, Nov. 2004, pp. 709-714; IDS reference). (Year: 2004).*
Khalil et al in "Synthetic biology: applications come of age" (Nature Reviews/Genetics, May 2010, vol. 11, pp. 367-379). (Year: 2010).*
Tan et al et al in "An essential transcription factor, SciP, enhances robustness of Caulobacter cell cycle regulation" (PNAS Early Edition, 2010, pp. 1-6). (Year: 2010).*
Storz in "An RNA thermometer" (Genes & Development 1999 vol. 13: pp. 633-636). (Year: 1999).*
Laub et al in "Genes directly controlled by CtrA, a master regulator of the Caulobacter cell cycle" (PNAS, Apr. 2, 2002, vol. 99, No. 7: pp. 4632-4637). (Year: 2002).*
Al, H.W., et al., Hue-shifted monomeric variants of *Clavularia* cyan fluorescent protein: identification of the molecular determinants of color and applications in fluorescence imaging. *BMC Biology* 6, 13-25, (2008). 13 pages.
Altschul, S.F., et al., "Gapped BLAST and PSI-BLAST: a new generation of protein database search programs." *Nucleic Acids Research* 25(17), 3389-3402, (1997). 14 pages.
Berman, H.M., et al., "The Protein Data Bank." *Acta Crystallographica Section D: Biological Crystallography* 58(6), 899-907, (2002). 9 pages.
Bertram, R., et al., "The application of Tet repressor in prokaryotic gene regulation and expression." *Microbial Biotechnology* 1(1), 2-16, (2008). 15 pages.
Böhme, K., et al., "Concerted Actions of a Thermo-Labile Regulator and a Unique Intergenic RNA Thermosensor Control *Yersinia* Virulence." *PLoS Pathogens* 8(2), e1002518, (2012). 23 pages.
Casadesüs, J., et al., "The virulence plasmids of *Salmonella*." *International Microbiology* 2(3), 177-184, (1999). 8 pages.
Chappell, J., et al., "The centrality of RNA for engineering gene expression." *Biotechnology Journal* 8(12), 1379-1395, (2013). 18 pages.
Chen, X., et al., "Fusion Protein Linkers: Property, Design and Functionality." *Advanced Drug Delivery Reviews* 65(10), 1357-1369, (2013). 32 pages.

(Continued)

*Primary Examiner* — Catherine S Hibbert
(74) *Attorney, Agent, or Firm* — Steinfl + Bruno, LLP

(57) ABSTRACT

Temperature sensitive transcriptional bioswitches and related genetic circuits and in particular bandpass and/or multiplex genetic circuits, vectors, cells, compositions methods and systems are described.

56 Claims, 34 Drawing Sheets

Specification includes a Sequence Listing.

(56) References Cited

OTHER PUBLICATIONS

Deckers, R., et al., Image-guided, noninvasive, spatiotemporal control of gene expression. *PNAS* 106(4), 1175-1180, (2009). 6 pages.

De Marco, A., et al., "Native folding of aggregation-prone recombinant proteins in *Escherichia coli* by osmolytes, plasmid- or benzyl alcohol-overexpressed molecular chaperones." *Cell Stress & Chaperones* 10(4), 329-339, (2005). 11 pages.

Drozdetskiy, A., et al., "JPred4: a protein secondary structure prediction server." *Nucleic Acids Research* 43, W389-W94, (2015). 6 pages.

Elias, W.J., et al., "A Pilot Study of Focused Ultrasound Thalamotomy for Essential Tremor." *New England Journal of Medicine* 369(7), 640-648, (2013). 9 pages.

Elowitz, M.B.. et al., A synthetic oscillatory network of transcriptional regulators. *Nature* 403(6767), 335-338, (2000). 4 pages.

Fite, B.Z., et al., "Magnetic Resonance Thermometry at 7T for Real-Time Monitoring and Correction of Ultrasound Induced Mild Hyperthermia." *PloS One* 7(4), e35509, (2012). 10 pages.

Flynn, R.L. et al., "Oligonucleotide/Oligosaccharide-Binding Fold Proteins: A Growing Family of Genome Guardians." *Critical Reviews in Biochemistry and Molecular Biology*, 45(4), 266-275, (2010). 17 pages.

Gal-Mor, O., et al., "The temperature-sensing protein TlpA is repressed by PhoP and dispensable for virulence of *Salmonella enterica* serovar Typhimurium in mice." *Microbes Infection* 8(8), 2154-2162, (2006). 9 pages.

Ganguly, T., et al., "A Point Mutation at the C-Terminal Half of the Repressor of Temperate Mycobacteriophage L1 Affects Its Binding to the Operator DNA." *Journal of Biochemistry and Molecular Biology* 37(6), 709-714, (2004). 6 pages.

García-Quintanilla, M, et al, "Bile-Induced Curing of the Virulence Plasmid in *Salmonella enterica* Serovar Typhimurium." *Journal of Bacteriology* 188(22), 7963-7965, (2006). 3 pages.

Gardner, T.S., et al., "Construction of a genetic toggle switch in *Escherichia coli.*" *Nature* 403(6767), 339-342, (2000). 4 pages.

Gelly, J.-C., et al., "iPBA: a tool for protein structure comparison using sequence alignment strategies." *Nucleic Acids Research* 39, W18-W23, (2011). 6 pages.

Grigoryan, G. et al., "Structural specificity in coiled-coil interactions." *Current Opinion in Structural Biology* 18(4), 477-483, (2008). 13 pages.

Herbst, K., et al., "Intrinsic Thermal Sensing Controls Proteolysis of *Yersinia* Virulence Regulator RovA." *PLoS Pathogens* 5(5), e1000435, (2009). 16 pages.

Hoe, N.P., et al., "Temperature Sensing in *Yersinia pestis*: Translation of the LcrF Activator Protein is Thermally Regulated." *Journal of Bacteriology* 175(24), 7901-7909, (1993). 9 pages.

Hooshangi, S., et al., "Ultrasensitivity and noise propagation in a synthetic transcriptional cascade." *PNAS* 102(10), 3581-3586, (2005). 6 pages.

Huang, D., et al., "A genetic bistable switch utilizing nonlinear protein degradation." *Journal of Biological Engineering* 6, p. 9, (2012). 13 pages.

Humphris, E.L., et al., "Prediction of Protein-Protein Interface Sequence Diversity Using Flexible Backbone Computational Protein Design." *Structure* 16(12), 1777-1788, (2008). 12 pages.

Hurme, R., et al., "DNA Binding Exerted by a Bacterial Gene Regulator with an Extensive Coiled-coil Domain." *Journal of Biological Chemistry* 271(21), 12626-12631, (1996). 8 pages.

Hurme, R., et al., "A Proteinaceous Gene Regulatory Thermometer in *Salmonella.*" *Cell* 90(1), 55-64, (1997). 10 pages.

Ilinkin, I. et al., "Multiple structure alignment and consensus identification for proteins." *BMC Bioinformatics* 11(1), p. 71, (2010). 8 pages.

Jensen, P.R., et al., "The use of lac-type promoters in control analysis." *European Journal of Biochemistry* 211(1-2), 181-191, (1993). 11 pages.

Kamp, H.D., et al., "A Protein Thermometer Controls Temperature-Dependent Transcription of Flagellar Motility Genes in *Listeria monocytogenes.*" *PLoS Pathogens* 7(8), e1002153, (2011). 15 pages.

Kortmann J., et al., "Translation on demand by a simple RNA-based thermosensor." *Nucleic Acids Research* 39(7), 2855-2868. (2011). 14 pages.

Koski, P., et al., "A New α-Helical Coiled Coil Protein Encoded by the *Salmonella typhimurium* Virulence Plasmid." *Journal of Biological Chemistry* 267(17), 12258-12265, (1992). 8 pages.

Kotula J. W., et al., "Programmable bacteria detect and record an environmental signal in the mammalian gut." *PNAS* 111(13), 4838-4843, (2014). 6 pages.

Kuhlman, B., et al., "Design of a Novel Globular Protein Fold with Atomic-Level Accuracy." *Science* 302(5649), 1364-1368, (2003). 6 pages.

Kyte, J, et al., "A Simple Method for Displaying the Hydropathic Character of a Protein." *Journal of Molecular Biology* 157(1), 105-132, (1982). 28 pages.

Lam, K.S., "Mini-review. Application of combinatorial library methods in cancer research and drug discovery." *Anti-Cancer Drug Design* 12(3), 145-167, (1997). 23 pages.

Lauck, F., et al., "RosettaBackrub—a web server for flexible backbone protein structure modeling and design." *Nucleic Acids Research* 38, W569-W575, (2010). 7 pages.

Lohse, M.B., et al., "Identification and characterization of a previously undescribed family of sequence-specific DNA-binding domains." *PNAS* 110(19), 7660-7665, (2013). 6 pages.

Lupas, A., M., et al., "Predicting Coiled Coils from Protein Sequences." *Science* 252(5009), 1162-1164, (1991). 3 pages.

Lutz R., et al., "Independent and tight regulation of transcriptional units in *Escherichia coli* via the LacR/O, the TetR/O and AraC/I1-I2 regulatory elements." *Nucleic Acids Research* 25(6), 1203-1210, (1997). 8 pages.

Maiti, R., et al., "SuperPose: a simple server for sophisticated structural superposition." *Nucleic Acids Research* 32, W590-W594, (2004). 5 pages.

Mangan, S., et al., "Structure and function of the feed-forward loop network motif." *PNAS* 100(21): p. 11980-11985, (2003). 6 pages.

McCabe, K.M., et al., "LacI(Ts)-Regulated Expression as an in Situ Intracellular Biomolecular Thermometer." *Applied Environmental Microbiology* 77(9), 2863-2868, (2011). 6 pages.

McDannold, N., et al., "MRI Investigation of the Threshold for Thermally Induced Blood-Brain Barrier Disruption and Brain Tissue Damage in the Rabbit Brain." *Magnetic Resonance in Medicine* 51(5), 913-923, (2004). 11 pages.

McDonnell, A.V., et al., "Paircoil2: improved prediction of coiled coils from sequence." *Bioinformatics* 22(3), 356-358, (2006). 3 pages.

Neupert, J., et al., Design of simple synthetic RNA thermometers for temperature-controlled gene expression in *Escherichia coli. Nucleic Acids Research* 36(19), e124, (2008). 9 pages.

Patyar, S. et al., "Bacteria in cancer therapy : a novel experimental strategy." *Journal of Biomedical Science* 17, p. 21, (2010). 9 pages.

Piraner, D.I., et al., "Tunable thermal bioswitches for in vivo control of microbial therapeutics." *Nature Chemical Biology*, doi: 10.1038/NCHEMBIO.2233 (2016). 13 pages.

Pogorzala, L.A., et al., "The Cellular Code for Mammalian Thermosensation." *The Journal of Neuroscience* 33(13), 5533-5541, (2013). 9 pages.

Renfrew, P.D., et al., "Incorporation of Noncanonical Amino Acids into Rosetta and Use in Computational Protein-Peptide Interface Design." *PLoS One* 7(3), e32637, (2012). 15 pages.

Rudaya, A.Y., et al., "Thermoregulatory responses to lipopolysaccharide in the mouse: dependence on the dose and ambient temperature." *American Journal of Physiology—Regulatory, Integrative and Comparative Physiology* 289(5), R1244-1252, (2005). 9 pages.

Servant, P., et al., "The RheA repressor is the thermosensor of the HSP18 heat shock response in *Streptomyces albus.*" *PNAS* 97(7), 3538-3543, (2000). 6 pages.

Shaner, N.C., et al., "Improved monomeric red, orange and yellow fluorescent proteins derived from *Discosoma* sp. red fluorescent protein." *Nature Biotechnology* 22(12), 1567-1572, (2004). 6 pages.

(56) References Cited

OTHER PUBLICATIONS

Skurnik M., et al., LcrF Is the Temperature-Regulated Activator of the yadA Gene of *Yersinia enterocolitica* and *Yersinia pseudotuberculosis*. *Journal of Bacteriology* 174(6), 2047-2051, (1992). 5 pages.
Stayrook, S., et al., "Crystal structure of the λ repressor and a model for pairwise cooperative operator binding." *Nature* 452, 1022-1025, (2008). 5 pages.
Steidler L., et al., "Treatment of Murine Colitis by *Lactococcus lactis* Secreting Interleukin-10." *Science* 289, 1352-1355, (2000). 4 pages.
Valdez-Cruz, N.A.., et al., "Production of recombinant proteins in *E. coli* by the heat inducible expression system based on the phage lambda pL and/or pR promoters." *Microbial Cell Factories* 9, p. 18, (2010). 16 pages.
Vincent, T.L., et al., "LOGICOIL—multi-state prediction of coiled-coil oligomeric state." *Bioinformatics* 29(1), 69-76, (2013). 8 pages.
Vogel, J., et al., "Temperature-Sensitive Mutations in the Bacteriophage Mu c Repressor Locate a 63-Amino-Acid DNA-Binding Domain." *Journal of Bacteriology* 173(20), 6568-6577, (1991). 10 pages.
Waldminghaus, T., et al., "Generation of synthetic RNA-based thermosensors." *Biological Chemistry* 389(10), 1319-1326, (2008). 9 pages.
Weiss, R., et al., "Genetic circuit building blocks for cellular computation, communications, and signal processing." *Natural Computing* 2(1), 47-84, (2003). 38 pages.
Wielgus-Kutrowska, B., et al., "Folding and unfolding of a non-fluorescent mutant of green fluorescent protein." *Journal of Physics: Condensed Matter* 19(28), 285223, (2007). 9 pages.
Wissmann, A., et al., "Selection for Tn10 Tet Repressor Binding to tet Operator in *Escherichia coli*: Isolation of Temperature-Sensitive Mutants and Combinatorial Mutagenesis in the DNA Binding Motif." *Genetics* 128(2), 225-232, (1991). 8 pages.
Ye, . Y., et al., "Flexible structure alignment by chaining aligned fragment pairs allowing twists." *Bioinformatics* 19(suppl 2), ii246-ii255, (2003). 10 pages.
Zhao, K., et al., "The Global Transcriptional Response of *Escherichia coli* to Induced Sigma32 Protein Involves Sigma32 Regulon Activation Followed by Inactivation and Degradation of Sigma32 in Vivo." *The Journal Biological Chemistry* 280(18), 17758-17768, (2005). 12 pages.
Al-Bataineh, O., et al., "Clinical and future applications of high intensity focused ultrasound in cancer", Cancer treatment reviews, 38(5), 346-353, 2012.
Brenowitz, M., et al., "Quantitative DNase footprint titration: A method for studying protein-DNA interactions", Methods in Enzymology. vol. 130.; 1985:132-181. doi:10.1016/0076-6879(86)30011-9.
Chao, Y.P., et al., "Construction and characterization of thermoinducible vectors derived from heat-sensitive lacI genes in combination with the T7 Al promoter", Biotechnology and bioengineering, 79(1), 1-8, 2002.
Dasika, M.S. et al. "OptCircuit: An optimization based method for computational design of genetic circuits", BMC Systems Biology, Mar. 3, 2008, 2:24 doi:10.1186/1752-0509-2-24. http://www.biomedcentral/1752-0509/2/24. 19 pages.
Del Vecchio, D., Murray, R.M. "Biomolecular Feedback Systems", bfs-pupss, dated Jun. 13, 2014. 280 pages. Published 2015 by Princeton University Press, 6 Oxford Street, Woodstock, Oxfordshire OX20 1TW, United Kingdom.
Dimaio, F. et al. "Refinement of Protein Structures into Low-Resolution Density Maps using Rosetta", J Mol Biol., Sep. 11, 2009, 392(1); 181-190. doi:10.1016/j.jmb.2009.07.008. 18 pages.
Gaitanaris, G., et al., Renaturation of Denatured λ Repressor Requires Heat Shock Proteins. Cell. 1990;61:1013-1020.
Haar, G.T. et al. "High intensity focused ultrasound: physical principles and devices", Int J Hyperthermia, 23(2), 89-104, 2007.

Hemrich, J., et al., "The cl repressor of bacteriophage P1 operator-repressor interaction of wild-type and mutant repressor proteins", Nucleic acids research, 17(19), 7681-7692, 1989.
Hu, et al., "Sequence requirements for coiled-coils: analysis with repressor-GCN4 leucine zipper fusions", Science 250, 1400-1403, 1990.
Klinkert, B., et al., "Microbial thermosensors", Cell Mol Life Sci 66(16), 2661-2676, (2009), doi:10.1007/s00018-009-0041-3.
Love, C.A., et al., "Stable high-copy-number bacteriophage lambda promoter vectors for overproduction of proteins in *Escherichia coli*", Gene. 1996;176(1-2):49-53. doi:10.1016/0378-1119(96)00208-9.
Marr, M.T., et al., "Promoter recognition as measured by binding of polymerase to nontemplate strand oligonucleotide", Science, 276(5316), 1258-60, 1997.
McDannold, N.J., et al., "Usefulness of MR Imaging-Derived Thermometry and Dosimetry in Determining the Threshold for Tissue Damage Induced by Thermal Surgery in Rabbits 1", Radiology 216(2), 517-523, 2000.
Myers, C.J. et al. "iBioSim: a tool for the analysis and design of genetic circuits", Bioinformatics, vol. 25, No. 21, 2009, pp. 2848-2849. Doi:10.1093/bioinformatics/btp457.
Niederholtmeyer, H., Sun, Z.Z., et al. "Rapid cell-free forward engineering of novel genetic ring oscillators", eLIFE, Research Article Oct. 2, 2015, doi: 10.7554.eLife.09771. Downloaded: Dec. 15, 2019. 59 pages.
Pabo, C.O., et al., "The operator-binding domain of lambda repressor: structure and DNA recognition", Nature, 298, 443-447, 1982.
Pinero-Lambea, C., et al., "Engineered bacteria as therapeutic agents", Curr Opin Biotechnol. 2015;35:94-102. doi:10.1016/j.copbio.2015.05.004.
Pritchard, M.T., et al., "Protocols for simulating the thermal component of fever: preclinical and clinical experience", Methods 32(1), 54-62, 2004.
Rohl, C.A. et al "[4] Protein Structure Prediction Using Rosetta" Methods in Enzymology, vol. 383, 2004, pp. 66-93.
Scott, M. et al. "Deterministic characterization of stochastic genetic circuits" PNAS, vol. 104, No. 18, May 1, 2007, pp. 7402-7407.
Shin, J., et al., "An *E. coli* cell-free expression toolbox: application to synthetic gene circuits and artificial cells", ACS Synth Biol, 1(1), 29-41, 2012.
Sprinzak, D. et al. "Reconstruction of genetic circuits" Nature, vol. 438, Nov. 24, 2005, pp. 443-448.
Wilson, C.J., et al., "The lactose repressor system: paradigms for regulation, allosteric behavior and protein folding", Cell Mol Life Sci, 64(1), 3-16, 2007.
Wood, C.W., et al. "CCBuilder: an interactive web-based tool for building, designing and assessing coiled-coil protein assemblies", Bioinformatics, vol. 30, No. 21, 2014, pp. 3029-3035. Doi: 10.1093/bioinformatics/btu502.
Zong, C., et al. "Lysogen stability is determined by the frequency of activity bursts from the fate-determining gene" Molecular Systems Biology, 6, Article No. 440, pp. 1-12, 2010. doi:10.1038/msb.2010.96.
Rosetta Commons: The hub for Rosetta modeling software. Sep. 29, 2015. 16 pages. http://www.rosettacommons.org.
"Salt bridge (protein and supramolecular)" Wikipedia Definition. Accessed online on Jul. 27, 2020 on https://en.wikipedia.org/wiki/Salt_bridge_(protein_and_supramolecular) . 7 Pages.
Apostolovic, B., et al., "Coiled Coils: Attractive Protein Folding Motifs for the Fabrication of Self-Assembled, Responsive and Bioactive Materials," Chem. Soc. Rev. Feb. 23, 2010, 39, 3541-3575. https://doi.org/10.1039/b914339b. 37 Pages.
Azuma, Y., et al., "Controlling leucine-zipper partner recognition in cells through modification of a-g Interactions," Chem Commun (Camb). 2014. 50(48): p. 6364-6367. 5 Pages.
Berggard, T., et al., "Methods for the Detection and Analysis of Protein-Protein Interactions," Proteomics, 2007, 7, 2833-2842. https://doi.org/10.1002/pmic.200700131. 12 pages.
"Bioconjugation", Wikipedia Definition. Accessed on Jul. 23, 2020. 13 Pages. Available from: https://en.wikipedia.org/wiki/Bioconjugation.

(56) References Cited

OTHER PUBLICATIONS

Bugaj, L. J., et al., "Optogenetic protein clustering and signaling activation in mammalian cells," Nature Methods, Published online Feb. 3, 2013, 10 (3), pp. 249-252. https://doi.org/10.1038/nmeth.2360 . 7 Pages.

Carpenter, A.E., et al.,"CellProfiler: image analysis software for identifying and quantifying cell phenotypes," Genome Biol, Oct. 31, 2006. 7(10): p. R100. 12 pages.

Cooper, T. M., et al., "The effect of conformation on the CD of interacting helices: A theoretical study of tropomyosin," Biopolymers, vol. 30, Issue 7-8, pp. 657-676. First Published in 1990. 21 Pages.

Cox, V. T., et al., "Specification of Individual Slouch Muscle Progenitors in Drosophila Requires Sequential Wingless Signaling," Development 2005, 132, 713-724. https://doi.org/10.1242/dev.01610 . 13 Pages.

Debiec, K., et al., "Evaluating the Strength of Salt Bridges: A Comparison of Current Biomolecular Force Fields," *J. Phys. Chem. B*,2014, 118, 24, 6561-6569. Published on Apr. 5, 2014. Available online at https://pubs.acs.org/doi/10.1021/jp500958r . 9 Pages.

Delviks, K.A., et al., "Effect of Distance between Homologous Sequences and 3' Homology on the Frequency of Retroviral Reverse Transcriptase Template Switching," *Journal of Virology*,1999. 73(10): p. 7923-7932. 11 Pages.

DeRose, R., et al., et al., "Manipulating Signaling at Will: Chemically-Inducible Dimerization (CID) Techniques Resolve Problems in Cell Biology," Pflügers Arch.—Eur. J Physiol. 2013, 465 (3), 409-417. https://doi.org/10.1007/s00424-012-1208-6 . 10 Pages.

Duplantis, Barry N. et al., Temperature-sensitive *Salmonella enterica* serovar enteritidis PT13a expressing essential proteins of psychrophilic bacteria, Applied and Environmental Microbiology, 2015, vol. 81, No. 19, pp. 6757-6766.

Gilbert, C., et al., "Biological Engineered Living Materials—Growing Functional Materials with Genetically-Programmable Properties. ACS Synth," Biol. 2019, 8(1), 1-15. https://doi.org/10.1021/acssynbio.8b00423 . 16 Pages.

Greenfield, N.J., "Using circular dichroism collected as a function of temperature to determine the thermodynamics of protein unfolding and binding interactions," Nat Protoc, 2006. 1(6): p. 2527-2535. 10 pages.

Guilhon, E., et al., "Spatial and temporal control of Transgene expression in vivo using a heat-sensitive promoter and MRI-Guided Focused Ultrasound," J. Gene Med. 2003, 5(4), 333-342. https://doi.org/10.1002/jgm.345 . 11 Pages.

"How Big is the Average Protein," downloaded from http://book.bionumbers.org/how-big-is-the-average-protein / on Jul. 27, 2020. 6 Pages.

Hurme, R., et al., "Intermediate filament-like network formed in vitro by a bacterial coiled coil Protein," *J Biol Chem*, 1994. 269(14): p. 10675-10682. 9 Pages.

International Search Report and Written Opinion for International Application No. PCT/US2020/041812 filed on Jul. 13, 2020 on behalf of California Institute of Technology, dated Nov. 17, 2020. 11 pages.

Justia Patent Search for U.S. Pat. No. 8,828,658. Published May 26, 2009, accessed on Jul. 27, 2020 on https://patents.justia.com/patent/8828658 . 47 Pages.

Kawe, M., et al., "Facile promoter deletion in *Escherichia coli* in response to leaky expression of very robust and benign proteins from common expression vectors," *Microb Cell Fact*,2009. 8 (8), 1-8. https://doi.org/10.1186/1475-2859-8-8 . 9 Pages.

Krajewski, S. S., et al., "Temperature-Driven Differential Gene Expression by RNA Thermosensors," *Biochim. Biophys. Acta—Gene Regul. Mech.* Mar. 21, 2014, 1839(10), 978-988. https://doi.org/10.1016/j.bbagrm.2014.03.006 . 12 Pages.

Liu, R. Y., et al. "Regulation of Chemical Stress-Induced Hsp70 Gene Expression in Murine L929 Cells," *J.Cell Sci.* 1994, 107, 2209-2214. 7 Pages.

Maresca, D., et al., "Biomolecular Ultrasound and Sonogenetics," Annu. Rev. Chem. Biomol. Eng. 2018, 9, 229-252. https://doi.org/10.1146/annurev-chembioeng-060817-084034 . 29 Pages.

Mason, J.M., et al., "Coiled coil domains: stability, specificity, and biological Implications," ChemBioChem, 2004. 5(2): p. 170-176. 8 Pages.

Mastop, M., et al., "Characterization of a spectrally diverse set of fluorescent proteins as FRET acceptors for mTurquoise2," Sci Rep, 2017. 7(1): p. 11999. 19 pages.

Moser, B. A., et al., "A Photoactivatable Innate Immune Receptor for Optogenetic Inflammation," ACS Chem. Biol. 2017, 12 (2), 347-350. https://doi.org/10.1021/acschembio.6b01012 . 5 pages.

Muller, K. M., et al., "Protein Fusions to Coiled-Coil Domains," In *Methods in Enzymology*; 2000; vol. 328, pp. 261-282. https://doi.org/10.1016/S0076-6879(00)28402-4 . 23 pages.

Muthuswamy, S. K., "Controlled Dimerization of ErbB Receptors Provides Evidence for Differential Signaling by Homo- and Heterodimers," Mol. Cell. Biol. Oct. 1999, 19 (10), 6845-6857. 14 Pages.

Piraner, D. I., et al., Going Deeper: Biomolecular Tools for Acoustic and Magnetic Imaging and Control of Cellular Function. Biochemistry 2017, 56 (39), pp. 5202-5209. https://doi.org/10.1021/acs.biochem.7b00443 . 9 Pages.

Piraner, D. I., et al., "Modular Thermal Control of Protein Dimerization," Publicly posted on Jul. 13, 2019. 7 Pages.

Piraner, D. I., et al., "Tunable Thermal Bioswitches for in Vivo Control of Microbial Therapeutics," *Nat. Chem. Biol.* 2017, 13 (1), 75-80. https://doi.org/10.1038/nchembio.2233 . 9 pages.

Royal, D. C., et al., "Temperature-Sensitive Mutant of the Caenorhabditis Elegans Neurotoxic MEC-4(d) DEG/ENaC Channel Identifies a Site Required for Trafficking or Surface Maintenance," J. Biol. Chem. Dec. 23, 2005, 280 (51), 41976-41986. https://doi.org/10.1074/jbc.M510732200 . 13 Pages.

Sadeghi, S. et al., Length-dependent force characteristics of coiled coils. Physical Review E, 80, 061909, 2009. 061909-1 to 061909-9.

Silva, F., et al., "Evaluating metabolic stress and plasmid stability in plasmid DNA production by *Escherichia coli*.," Biotechnol Adv, 2012. 30(3): p. 691-708. 19 Pages.

Spencer, D. M., et al., "Controlling Signal Transduction with Synthetic Ligands," Science, 1993, 262 (5136), 1019-1024. 8 Pages.

Stanton, B.Z., et al., "Chemically induced proximity in biology and medicine," *Science*, 2018. 359 (6380). 12 Pages.

Tripet, B., et al., "Engineering a de novo-designed coiled-coil heterodimerization domain for the rapid detection, purification and characterization of recombinantly expressed peptides and proteins," *Protein Eng*, 1996. 9(11): p. 1029-1042. 16 pages.

"Stroke's Law" Wikipedia Definition. Accessed on Jul. 27, 2020 from https://en.wikipedia.org/wiki/Stokes%27_law . 7 Pages.

Woolley, G. A., et al. "Reversible photocontrol of DNA binding by a designed GCN4-bZIP protein." Biochemistry 45(19): 6075-6084. 2006. 11 pages.

Wu, C.-Y., et al. "Remote Control of Therapeutic T Cells through a Small Molecule-Gated Chimeric Receptor," Science, Oct. 16, 2015, 350 (6258). https://doi.org/10.1126/science.aab4077. 13 Pages.

Wu, C.-Y., et al., "Synthetic Biology Approaches to Engineer T Cells". Curr. Opin. Immunol. 2015, 35, 123-130. https://doi.org/10.1016/j.coi.2015.06.015 . 9 pages.

Yuzawa, S., et al., "Activating an Enzyme by an Engineered Coiled Coil Switch," Chem. Eur. J. 2006, 12, 7345-7352. https://doi.org/10.1002/chem.200600007 . 9 pages.

Zhou, NE., et al., "Synthetic model proteins: the relative contribution of leucine residues at the nonequivalent positions of the 3-4 hydrophobic repeat to the stability of the two-stranded alpha-helical coiled-coil," *Biochemistry*. 1992, 31, 5739-5746.9 Pages.

\* cited by examiner a

TlpA DNA

```
atgcgtccggcgacatacgaaccagaacagattattgaagcagggctggccctgcaggc
tgaaggacggaatatcaccgggttcgcactacgtaaccaggtgggtggcggcaatccga
cacgtctccgccagatatgggacgaataccaggcttcacagagcacggtcgtcactgaa
cccgttgccgagctgccagtggaagtggctgaagaagtgaaggccgtctccgccgcgct
gtccgaacgcatcacccagctggcgacagaactgaatgacaaggcggtccgggctgcag
aacgccgggttgcggaagtcacgcgtgctgccggtgaacagaccgcacaggcagagcgg
gagctggccgacgccgcgcagacagtcgacgacctggaagaaaaactggatgaactgca
ggacagatatgacagtttgacgctggcgctggagtcagaacgttcactgcgtcagcagc
atgatgtggagatggcccagctgaaagagcgtcttgcggccgctgaagagaatacccgt
cagcgagaggaacggtatcaggagcagaagacagtgctgcaggatgcgcttaatgcgga
gcaggcacagcacaaaaacgcgggaagacctgcagaaacgactggagcaaatttctg
ccgaagctaatgcgcgtacagaagaactgaagtctgaacgcgataaagtcaatactctc
cttacccgccttgaatcgcaggaaaatgcgctggcctcagaacgtcagcagcatctggc
cacccgcgaaacgctgcagcaacgcctcgagcaggccatcgctgacacgcaggcgcgcg
ccggtgagattgcacttgaacgtgacagagtcagcagcctcaccgcaaggctggaatcg
caggaaaaggcctcctcggagcaactggtgcgtatgggcagtgaaatagccagtctgac
agagcgttgcacacagctggaaaaccagcgtgatgatgcccgtctggagacgatggggg
agaaagaaacggtcgcggcactgcgtggtgaggctgaagccctgaagcgtcagaaccag
tcactgatggcggcgtttcaggcaataaacagaccggtggccagaatgcgtga
``` b

TlpA Protein

```
MRPATYEPEQIIEAGLALQAEGRNITGFALRNQVGGGNPTRLRQIWDEYQASQSTVVTE
PVAELPVEVAEEVKAVSAALSERITQLATELNDKAVRAAERRVAEVTRAAGEQTAQAER
ELADAAQTVDDLEEKLdELQDRYDSLTLALESERSLRQQHDVEMAQLKERLAAAEENTR
QREERYQEQKTVLQDALNAEQAQHKNTREDLQKRLEQISAEANARTEELKSERDKVNTL
LTRLESQENALASERQQHLATRETLQQRLEQAIADTQARAGEIALERDRVSSLTARLES
QEKASSEQLVRMGSEIASLTERCTQLENQRDDARLETMGEKETVAALRGEAEALKRQNQ
SLMAALSGNKQTGGQNA*
```

FIG. 11 a

TlpA₃₆ DNA atgcgtccggcgacatacgaaccagaacagattattgaagcagggctggccctgcaggc
tgaaggacggaatatcaccgggttcgcactacgtaaccaggtgggtggcggcaatccga
cacgtctccgccagatatgggacgaataccaggcttcacagagcacggtcgtcactgaa
cTcgttgccgagctgccagtggaagtggctgaagaagtgaaggccgtctccgccgcgct
gtccgaacgcatcacccagctggcgacagaactgaatgacaaggcggtccgggctgcag
aacgccgggttgcggaagtcacgcgtgctgccggtgaacagaccgcacaggcagagcgg
gagctggccgacgccgcgcagacagtcgacgacctggaagaaaaactggTtgaactgca
ggacagatatgacagtttgacgctggcgctggagtcagaacgttcactgcgtcagcagc
atgatgtggagatggcccagctgaaagagcgtcttgcggccgctgaagagaatacccgt
cagcgagaggaacggtatcaggagcagaGgacagtgctgcaggatgcgcttaatgcgga
gcaggcacagcacaTaaacacgcgggaagaccAgcagaaacgactggagcaaatttctg
ccgaagctaatgcgcgtacagaagaactgaagtctgaacgcgataaagtcaatactctc
cttacccgccttgaatcgcaggaaaatgcgctggcctcagaacgtcagcagcatctggc
cacccgcgaaacgctgcagcaacgcctcgagcaggccatcgctgacacgcaggcgcgcg
ccggtgagattgcacttgaacgtgacagagtcagcagcctcaccgcaaggctggaatcg
caggaaaaggcctcctcggagcaactggtgcgtatgggcagtgaaatagccagtctgac
agagcgttgcacacagctggaaaaccagcgtgatgatgcccgtctggagacgatggggg
agaaagaaacggtcgcggcactgcgtggtgaggctgaagccctgaagcgtcagaaccag
tcactgatggcggcgctttcaggcaataaacagaccggtggccagaatgcgtga b

TlpA₃₆ Protein

MRPATYEPEQIIEAGLALQAEGRNITGFALRNQVGGGNPTRLRQIWDEYQASQSTVVTE
LVAELPVEVAEEVKAVSAALSERITQLATELNDKAVRAAERRVAEVTRAAGEQTAQAER
ELADAAQTVDDLEEKLVELQDRYDSLTLALESERSLRQQHDVEMAQLKERLAAAEENTR
QREERYQEQRTVLQDALNAEQAQHINTREDQQKRLEQISAEANARTEELKSERDKVNTL
LTRLESQENALASERQQHLATRETLQQRLEQAIADTQARAGEIALERDRVSSLTARLES
QEKASSEQLVRMGSEIASLTERCTQLENQRDDARLETMGEKETVAALRGEAEALKRQNQ
SLMAALSGNKQTGGQNA*

FIG. 12 a

TlpA$_{39}$ DNA atgcgtccggcgacatacgaaccagaacagattattgaagcagggctggccctgcaggc
tgaaggacggaatatcaccgggttcgcactacgtaaccaggtgggtggcggcaatccga
cacgtctccgccagatatgggacgaataccaggcttcacagagcacggtcgtcactgaa
cccgttgccgagctgccagtggaagtggctgaagaagtgaaggccgtctccgccgcgct
gtccgaacgcatcacccagctggcgacagaactgaatgacaaggcggtccgggctgcag
aacgccgggttgcggaagtcacgcgtgctgccggtgaacagaccgcacaggcagagcgg
gagctggccgacgccgcgcagacagtcgacgacctggaagaaaaactggTtgaactgca
ggacagatatgacagtttgacgctggcgctggagtcagaacgttcactgcgtcagcagc
atgatgtggagatggcccagctgaaagagcgtcttgcggccgctgaagagaatacccgt
cagcgagaggaacggtatcaggagcagaagacagtgctgcaggatgcgcttaatgcgga
gcaggcacagcacaaaaacacgcgggaagacctgcagaaacgactggagcaaatttctg
TcgaagctaatgcgcgtacagaagaactgaagtctgaacgcgataaagtcaatactTtc
cttacccgccttgaatcgcaggaaaatgcgctggcctcagaacgtcagcagcatctggc
cacccgcgaaacgctgcagcaacgcctcgagcaggccatcgctgacacgcaggcgcgcg
ccggtgagattgcacttgaacgtgacagagtcagcagcctcaccgcaaggctggaatcg
caggaaaaggcctcctcggagcaactggtgcgtatgggcagtgaaatagccagtctgac
agagcgttgcacacagctggaaaaccagcgtgatgatgcccgtctggagacgatggggg
agaaagaaacggtcgcggcactgcgtggtgaggctgaagccctgaagcgtcagaaccag
tcactgatggcggcgctttcaggcaataaacagaccggtggccagaatgcgtga b

TlpA$_{39}$ Protein

MRPATYEPEQIIEAGLALQAEGRNITGFALRNQVGGGNPTRLRQIWDEYQASQSTVVTE
PVAELPVEVAEEVKAVSAALSERITQLATELNDKAVRAAERRVAEVTRAAGEQTAQAER
ELADAAQTVDDLEEKLVELQDRYDSLTLALESERSLRQQHDVEMAQLKERLAAAEENTR
QREERYQEQKTVLQDALNAEQAQHKNTREDLQKRLEQISVEANARTEELKSERDKVNTF
LTRLESQENALASERQQHLATRETLQQRLEQAIADTQARAGEIALERDRVSSLTARLES
QEKASSEQLVRMGSEIASLTERCTQLENQRDDARLETMGEKETVAALRGEAEALKRQNQ
SLMAALSGNKQTGGQNA*

FIG. 13

DNA binding domain (residues 1 to 69):
MRPATYEPEQIIEAGLALQAEGRNITGFALRNQVGGGNPTRLRQIWDEYQASQSTVVTEPVAELPVEVA Heptad repeat 'A' (residues 70 to 92):
Amino acid sequence:          EEVKAVSAALSERITQLATELND
Heptad register:              bcdefgabcdefgabcdefgabcde Heptad repeat 'B' (residues 93 to 108):
Amino acid sequence:          KAVRAAERRVAEVTRA
Heptad register:              fgabcdefgabcdefgabc Heptad repeat 'C' (residues 109 to 152):
Amino acid sequence:          AGEQTAQAERELADAAQTVDDLEEK
Heptad register:              defgabcdefgabcdefgabcdefg Amino acid sequence (cont.):  LDELQDRYDSLTLALESER
Heptad register (cont.):      abcdefgabcdefgabcdefgabcde Amino acids between heptad repeats 'C' and 'D' (doesn't fit to heptad)
Amino acid sequence:   SL Heptad repeat 'D' (residues 155 to 178):
Amino acid sequence:          RQQHDVEMAQLKERLAAAEENTRQ
Heptad register:              abcdefgabcdefgabcdefgab Amino acid between heptad repeats 'D' and 'E' (doesn't fit to heptad)
Amino acid:                   R Heptad repeat 'E' (residues 180 to 193):
Amino acid sequence:          EERYQEQKTVLQDA
Heptad register:              efgabcdefgabcdefg Heptad repeat 'F' (residues 194 to 198):
Amino acid sequence:          LNAEQ
Heptad register:              abcde Heptad repeat 'G' (residues 199 to 221):
Amino acid sequence:          AQHKNTREDLQKRLEQISAEANA
Heptad register:              bcdefgabcdefgabcdefgabcdefg Amino acid between heptad repeats 'G' and 'H' (doesn't fit to heptad):
Amino acid:                   R

FIG. 15

Heptad repeat 'H' (residues 223 to 232):
Amino acid sequence: TEELKSERDK
Heptad register: abcdefgabcd Heptad repeat 'I' (residues 233 to 236):
Amino acid sequence: VNTL
Heptad register: abcd Amino acid between heptad repeats 'I' and 'J' (doesn't fit to heptad):
Amino acid: L Heptad repeat 'J' (residues 238 to 253):
Amino acid sequence: TRLESQENALASERQQ
Heptad register: fgabcdefgabcdefgabc Heptad repeat 'K' (residues 254 to 262):
Amino acid sequence: HLATRETLQ
Heptad register: defgabcdef Heptad repeat 'L' (residues 263 to 278):
Amino acid sequence: QRLEQAIADTQARAGE
Heptad register: bcdefgabcdefgabcdef Amino acids between heptad repeats 'L' and 'M' (doesn't fit to heptad)
Amino acid sequence: IALERDRVSSLTARLESQEKASSEQLVRMG Heptad repeat 'M' (residues 309 to 361):
Amino acid sequence: SEIASLTERCTQLENQRDDARLETM
Heptad register: fgabcdefgabcdefgabcdefgab Amino acid sequence (cont.): GEKETVAALRGEAEALKRQNQSLMAAL
Heptad register (cont.): cdefgabcdefgabcdefgabcdefgabc Amino acids after heptad repeat 'M' (doesn't fit to heptad):
Amino acid sequence: SGNKQTGGQNA*

FIG. 15 (cont.)

a
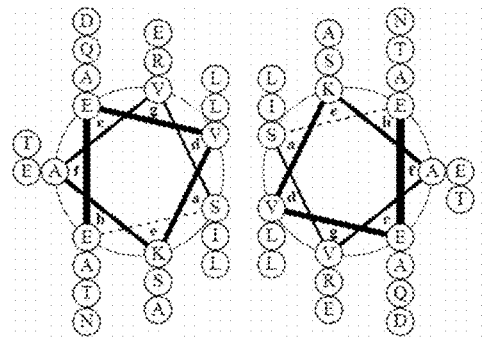
b
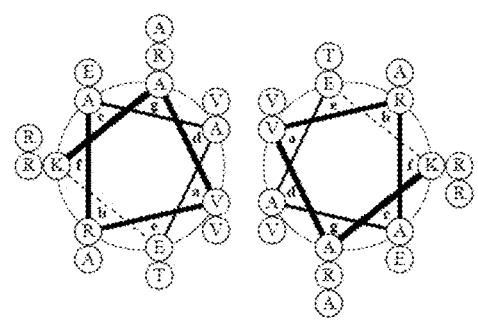
c
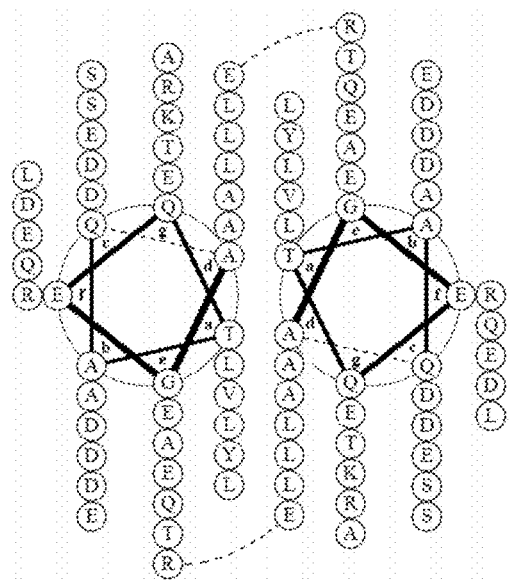
FIG. 16 d
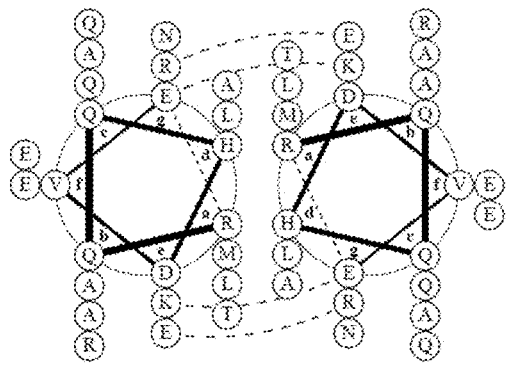
e
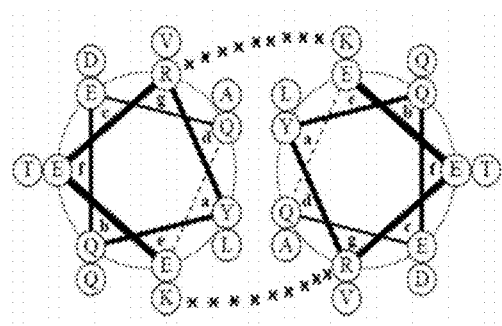
f
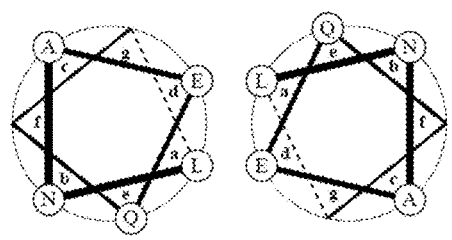
FIG. 16 (cont.)

g
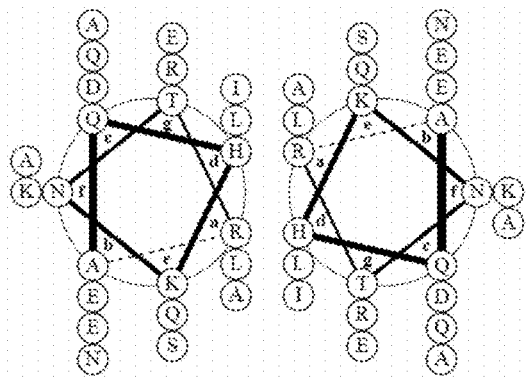
h
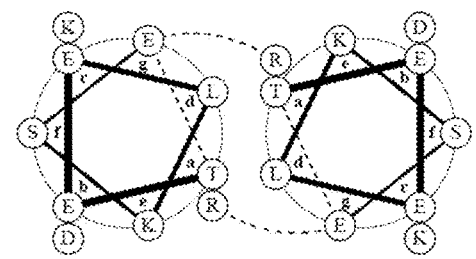
i
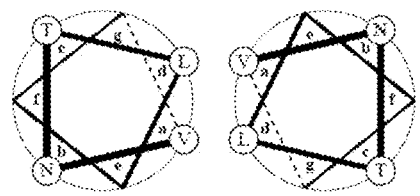
j
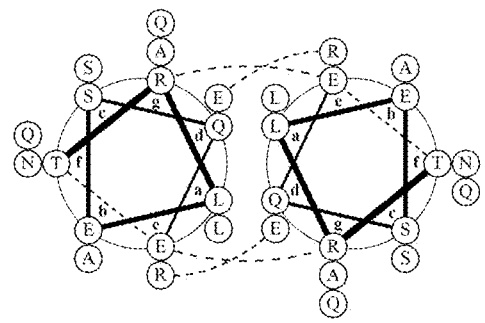
FIG. 16 (cont.)

k
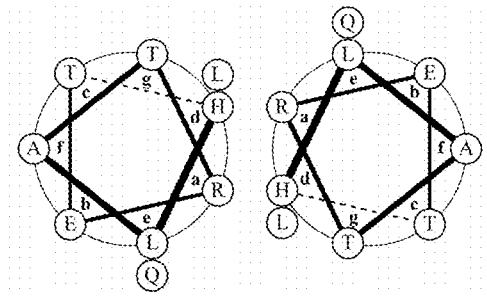
l
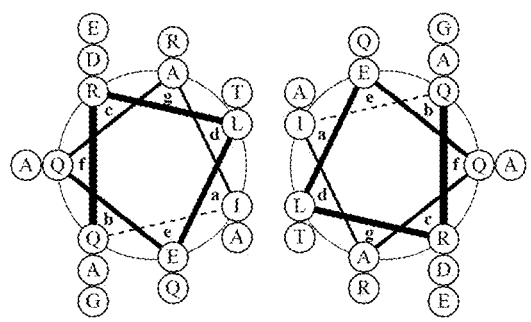
m
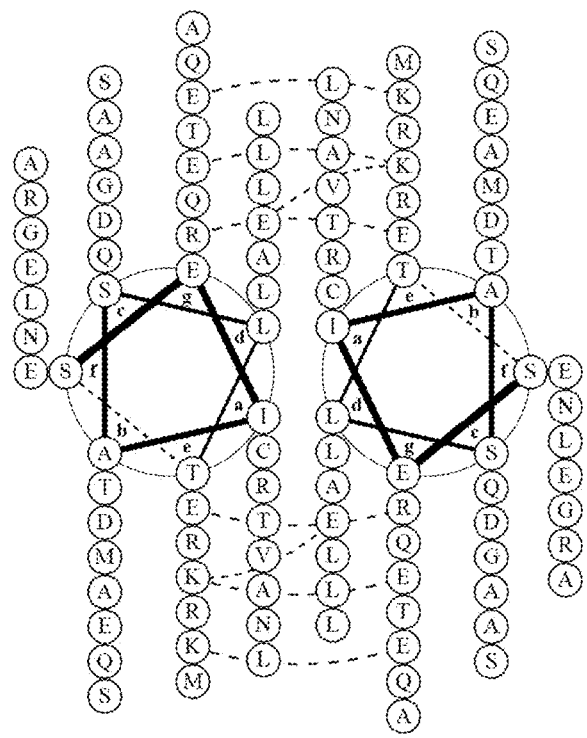
FIG. 16 (cont.)

MRPATYEPEQIIEAGLALQAEGRNITGFALRNQVGGGNPTRLRQIWDEYQASQ
-------HHHHHHHHHHHH------HHHHHH------HHHHHHHHHHH--

STVVTEFVAELPVEVAEEVKAVSAALSERITQLATELNDKAVRAAERRVAEV
----------HHHHHHHHHHHHHHHHHHHHHHHHHHHHHHHHHHHHHHHHH

TRAAGEQTAQAERELADAAQTVDDLEEKLDELQD
HHHHHHHHHHHHHHHHHHHHHHHHHHHHHHHHH

FIG. 17 a

TcI DNA:

atgagcacaaaaaagaaaccattaacacaagagcagcttgaggacgcacgtcgccttaa
agcaatttatgaaaaaagaaaaatgaacttggcttatcccaggaatctgtcgcagaca
agatggggatggggcagtcaggcgttggtgctttatttaatggcatcaatgcattaaat
gcttataacgccgcattgcttacaaaaattctcaaagttagcgttgaagaatttagccc
ttcaatcgccagagaaatctacgagatgtatgaagcggttagtatgcagccgtcactta
gaagtgagtatgagtaccctgttttttctcatgttcaggcagggatgttctcacctgag
cttagaacctttaccaaggtgatgcggagagatgggtaagcacaaccaaaaaagccag
tgattctgcattctggcttgaggttgaaggtaattccatgaccgcaccaacaggctcca
agccaagctttcctgacggaatgttaattctcgttgaccctgagcaggctgttgagcca
ggtgatttctgcatagccagacttgggggtgatgagtttaccttcaagaaactgatcag
ggatagcggtcaggtgttttacaaccactaaacccacagtacccaatgatcccatgca
atgagagttgttccgttgtggggaaagttatcgctagtcagtggcctgaagagacgttt
ggctga b

TcI Protein

<u>M</u>STKK<u>K</u>PLTQEQLEDARRLKAIYEKKKNELGL<u>S</u>QESVADKMGMGQSGVGALFNGINALN
A<u>Y</u>NAA<u>LL</u>t<u>K</u>ILKVSVEEFSPSIAREIYEMYEAVSMQPSLRSEYEYPVFSHVQAGM<u>F</u>SPE
<u>LRTF</u>TKG<u>D</u>AERWVSTTKKASDSAFWLEVEGNSMTAPTGSKPSFPDGMLILVDPEQAVEP
GDFCIARLGG<u>D</u>EFTFKKLIRDSGQVFLQPLNPQYPMIPCNESCSVVGKVIASQWPEETF
G*

FIG. 18 a

TcI38 DNA:

gtgagcacaaaaaagaaaccattaacacaagagcagcttgaggacgcacgtcgccttaa
agcaatttatgaaaaaagaaaaatgaacttggcttatcccaggaatctgtcgcagaca
agatggggatggggcagtcaggcgttggtgccttatttaatggcatcaatgcattaaat
gcttataacgccgcatcgcttacaagaattctcaaagttagcgttgaagaatttagccc
ttcaatcgccagagaaatctacgagatgtatgaagcggttagtatgcagccgtcactta
gaagtgagtatgagtaccctgttttttctcatgttcaggcagggatgctctcacctgag
cttagaacctttaccaaggtggtgcggaaaggtgggtaagcacaaccaaaaaagccag
tgattctgcattctggcttgaggttgaaggtaattccatgacagcaccaacaggctcca
agccaagctttcctgacggaatgttaattctcgttgaccctgagcaggctgttgagcca
ggtgatttctgcatagccagactcgggggtggtgagtttaccttcaagaaactgatcag
ggatagcggtcaggtgttttacaaccactaaaccacagtacccaatgatcccatgca
atgagagttgttccgttgtggggaaagttatcgctagtcagtggcctgaagagacgttt
ggctga b

TcI38 Protein:

VSTKKKPLTQEQLEDARRLKAIYEKKKNELGLSQESVADKMGMGQSGVGALFNGINALN
AYNAASLTRILKVSVEEFSPSIAREIYEMYEAVSMQPSLRSEYEYPVFSHVQAGMLSPE
LRTFTKGGAERWVSTTKKASDSAFWLEVEGNSMTAPTGSKPSFPDGMLILVDPEQAVEP
GDFCIARLGGGEFTFKKLIRDSGQVFLQPLNPQYPMIPCNESCSVVGKVIASQWPEETF
G*

FIG. 19 a

TcI₄₂ DNA:

atgagcacaaaaaagaatccattaacacaagagcagcttgaggacgcacgtcgccttaa
agcaatttatgaaaaaagaaaaatgaacttggcttaacccaggaatctgtcgcagaca
agatggggatggggcagtcaggcgttggtgctctatttaatggcatcaatgcattaaat
gctcataacgccgcattgcttacaaaaattctcaaagttagcgttgaagaatttagccc
ttcaatcgccagagaaatctacgagatgtatgaagcggttagtatgcagccgtcactta
gaagtgagtatgagtaccctgttttttctcatgttcaggcagggatgttctcacctgag
cctagaacctgtaccaaggtgatgcggagagatgggtaagcacaaccaaaaaagccag
tgattctgcattctggcttgaggttgaaggtaattccatgaccgcaccaacaggctcca
agccaagctttcctgacggaatgttaattctcgttgaccctgagcaggctgttgagcca
ggtgatttctgcatagccagacttgggggtgatgagtttaccttcaagaaactgatcag
ggatagcggtcaggtgttttacaaccactaaacccacagtacccaatgatcccatgca
atgagagttgttccgttgtggggaaagttatcgctagtcagtggcctgaagagacgttt
ggctga b

TcI₄₂ Protein:

MSTKKNPLTQEQLEDARRLKAIYEKKKNELGLTQESVADKMGMGQSGVGALFNGINALN
AHNAALLTKILKVSVEEFSPSIAREIYEMYEAVSMQPSLRSEYEYPVFSHVQAGMFSPE
PRTCTKGDAERWVSTTKKASDSAFWLEVEGNSMTAPTGSKPSFPDGMLILVDPEQAVEP
GDFCIARLGGDEFTFKKLIRDSGQVFLQPLNPQYPMIPCNESCSVVGKVIASQWPEETF
G*

FIG. 20

TcI

MSTKKKPLTQEQLEDARRLKAIYEKKKNELGLSQESVADKMGMGQSGVGALFNGINALN
AYNAALLTKILKVSVEEFSPSIAREIYEMYEAVSM*QPSLRSEYEYPVFSHVQAGMFSPE
LRTFTKGDAERWVS*TTKKASDSAFWLEVEGNSMTAPTGSKPSFPDGMLILVDPEQAVEP
GDFCIARLGGDEFTFKKLIRDSGQVFLQPLNPQYPMIPCNESCSVVGKVIASQWPEETF
G*

FIG. 21

| Amino Acid | 3-Letter | 1-Letter | Side-chain class | Side-chain polarity | Side-chain charge (pH 7.4) | Hydropathy index | Absorbance λmax(nm) | ε at λmax (mM⁻¹ cm⁻¹) | MW (Weight) |
|---|---|---|---|---|---|---|---|---|---|
| Aspartic acid | Asp | D | acid | acidic polar | negative | -3.5 | | | 133.104 |
| Glutamic acid | Glu | E | acid | acidic polar | negative | -3.5 | | | 147.131 |
| Alanine | Ala | A | aliphatic | nonpolar | neutral | 1.8 | | | 89.094 |
| Asparagine | Asn | N | amide | polar | neutral | -3.5 | | | 132.119 |
| Cysteine | Cys | C | sulfur-containing | nonpolar | neutral | 2.5 | 250 | 0.3 | 121.154 |
| Glutamine | Gln | Q | amide | polar | neutral | -3.5 | | | 146.146 |
| Glycine | Gly | G | aliphatic | nonpolar | neutral | -0.4 | | | 75.067 |
| Isoleucine | Ile | I | aliphatic | nonpolar | neutral | 4.5 | | | 131.175 |
| Leucine | Leu | L | aliphatic | nonpolar | neutral | 3.8 | | | 131.175 |
| Methionine | Met | M | sulfur-containing | nonpolar | neutral | 1.9 | | | 149.208 |
| Phenylalanine | Phe | F | aromatic | nonpolar | neutral | 2.8 | 257, 206, 188 | 0.2, 9.3, 60.0 | 165.192 |
| Proline | Pro | P | cyclic | nonpolar | neutral | -1.6 | | | 115.132 |
| Serine | Ser | S | hydroxyl-containing | polar | neutral | -0.8 | | | 105.093 |
| Threonine | Thr | T | hydroxyl-containing | polar | neutral | -0.7 | | | 119.119 |
| Tryptophan | Trp | W | aromatic | nonpolar | neutral | -0.9 | 280, 219 | 5.6, 47.0 | 204.228 |
| Tyrosine | Tyr | Y | aromatic | polar | neutral | -1.3 | 274, 222, 193 | 1.4, 8.0, 48.0 | 181.191 |
| Valine | Val | V | aliphatic | nonpolar | neutral | 4.2 | | | 117.148 |
| Arginine | Arg | R | basic | basic polar | positive | -4.5 | | | 174.203 |
| Lysine | Lys | K | basic | basic polar | positive | -3.9 | | | 146.189 |
| Histidine | His | H | basic aromatic | basic polar | positive(10%) neutral(90%) | -3.2 | 211 | 5.9 | 155.156 |

FIG. 24

THERMAL BIOSWITCHES AND RELATED GENETIC CIRCUITS, VECTORS, CELLS, COMPOSITIONS, METHODS AND SYSTEMS

CROSS REFERENCE TO RELATED APPLICATIONS

The present application claims priority to U.S. Provisional Application No. 62/269,715, entitled "Tunable Thermal Control of Transcription with Engineered Bioswitches" filed on Dec. 18, 2015, which is incorporated herein by reference in its entirety.

STATEMENT OF INTEREST

This invention was made with government support under Grant No. D14AP00050 awarded by the Department of the Interior. The government has certain rights in the invention.

FIELD

The present disclosure relates to thermal bioswitches and related genetic circuits, vectors and cells, as well as related compositions, methods and systems. In particular, the present disclosure relates to thermal bioswitches and related methods and systems to control activation and deactivation of genetic circuits in engineered cells.

BACKGROUND

Recent advances in synthetic biology are driving the development of genetically engineered cells for use in various applications wherein control of activation and deactivation one or more functions of the engineered cell is desired.

For example, a critical capability of cells engineered for use as therapeutic and diagnostic agents to treat human diseases, is the ability to control activation of the therapeutic or diagnostic functions of the engineered cells at anatomical and disease sites such as the gastrointestinal tract or tumors.

Despite development of molecular switches to control cells function, challenges remain for developing high-performance and/or tunable bioswitches to control gene expression in engineered cells in a wide range of applications including biomedical and industrial applications.

SUMMARY

Provided herein are thermal bioswitches and related genetic circuits, vectors and cells, as well as related compositions, methods and systems which can be used to provide a tunable control of one or more cell functions. In particular, in several embodiments thermal bioswitches herein described can be used to provide thermally controllable ultrasound, multiplexed and bandpass genetic circuit.

According to a first aspect, a coiled coil temperature sensitive transcription factor is described. The coiled coil temperature sensitive transcription factor comprises two monomer proteins configured to bind to one another to form a dimer in a target environment comprising a target DNA polynucleotide having a DNA coding region under control of a DNA regulatory region, the dimer configured to have a DNA-bound state and an DNA-unbound state with respect to specific binding of the dimer to the target DNA polynucleotide in the target environment In the coiled coil temperature sensitive transcription factor, each monomer protein comprises a dimerization dependent DNA binding domain and a coiled coil temperature sensing domain, each having a N-terminus and a C-terminus, the N-terminus of the coiled coil temperature sensing domain is covalently attached to the C-terminus of the DNA binding domain.

In the dimerization dependent DNA binding domain of the coiled coil temperature sensitive transcription factor, each monomer protein has an amino acid sequence configured to specifically bind the DNA regulatory region of the DNA polynucleotide in the target environment.

In the coiled coil temperature sensing domain, the two monomer proteins are configured to bind to one another in the target environment with a binding constant $Kd \leq 100$ nM in the DNA-bound state and $\geq 10$ uM in the DNA-unbound state wherein $$K_d = e^{\left(\frac{\Delta G}{RT}\right)} \qquad \text{Eq. (1)}$$

in which R is the gas constant, T is the temperature of the target environment and $\Delta G$ is the molar Gibbs free energy. The two monomer proteins of the coiled coil temperature sensing domain are further configured to bind to one another in the target environment with a thermal Hill coefficient above 15 to form the dimer in a temperature dependent manner.

In the coiled coil temperature sensing domain, each monomer protein has a coiled coil temperature sensing amino acid sequence having a length from 14 to 3200 amino acid residues, and a sequence

[$X_1 X_2 X_3 X_4 X_5 X_6 X_7$]$_n$ wherein $X_1$ is a hydrophobic amino acid, $X_2$ is a polar or charged amino acid, $X_3$ is a polar or charged amino acid, $X_4$ is a hydrophobic amino acid, $X_5$ is a polar or charged amino acid, $X_6$ is a polar or charged amino acid, and $X_7$ is a polar or charged amino acid and n can be any integer between 2 to 457 (SEQ ID NO: 1 to SEQ ID NO: 456).

In the coiled coil temperature sensitive transcription factor, the coiled coil temperature sensing amino acid sequence of each monomer protein can comprise one or more insertions, deletions or replacements with a percent variation with respect to SEQ ID NO: 1 to SEQ ID NO: 456 from 0% to 20%. In the coiled coil temperature sensing amino acid sequence of each monomer protein, residues $X_1$ to $X_7$ are arranged in the temperature sensing amino acid sequence to form consecutive uninterrupted series of 2 to 457 heptad repeats a, b, c, d, e, f, or g, at least two heptad repeats of the 2 to 457 heptad repeats having a register in which no amino acid is missing, and up to 455 heptad repeats a register in which up to 5 consecutive amino acid residues are optionally missing.

In the coiled coil temperature sensitive transcription factor, the temperature sensing domain has a melting temperature Tm defining a bioswitch temperature of the temperature sensitive transcription factor (Tbs), the Tbs being a temperature of the target environment at which the temperature sensitive transcription factor is converted from the DNA bound state to the DNA unbound state, with Tbs=Tm+0° C. to 5° C.

In some embodiments, each monomer protein of the coiled coil temperature sensitive transcription factor is engineered to replace at least one amino acid residue of the temperature sensing domain to have a reduction or an increase in the melting temperature Tm to provide a temperature sensitive transcription factors with an increased or decreased Tbs.

According to a second aspect, a globular temperature sensitive transcription factor is described. The globular temperature sensitive transcription factor comprises two monomer proteins each having a length from 106 to 750 amino acids and is configured to bind to one another to form a dimer in a target environment comprising a target DNA polynucleotide having a DNA coding region under control of a DNA regulatory region, the dimer configured to have a DNA-bound state and a DNA-unbound state with respect to specific binding of the dimer to the target DNA polynucleotide in the target environment.

In the globular temperature sensitive transcription factor, each monomer protein comprises a dimerization dependent DNA binding domain and a globular temperature sensing domain, each having a N-terminus and a C-terminus, the N-terminus of the temperature sensing domain covalently attached to the C-terminus of the DNA binding domain.

In the dimerization dependent DNA binding domain of the globular temperature sensitive transcription factor, each monomer protein has an amino acid sequence configured to specifically bind the DNA regulatory region of the DNA polynucleotide in the target environment.

In the globular temperature sensing domain, the two monomer proteins are configured to bind to one another in the target environment with a binding constant Kd≤100 nM in the DNA-bound state and ≥10 uM in the DNA-unbound state wherein $$K_d = e^{\left(\frac{\Delta G}{RT}\right)}$$ Eq. (1)

in which R is the gas constant, T is the temperature of the target environment and ΔG is the molar Gibbs free energy. The two monomer proteins of the coiled coil temperature sensing domain are further configured to bind to one another in the target environment with a thermal Hill coefficient above 15 to form the dimer in the target environment in a temperature dependent manner.

The globular temperature sensing domain has a length of 105 amino acids, and comprises an A bend, a B bend, a C bend, a D bend, an E bend, an F bend, a G bend, an H bend, an I bend, a J bend, a K bend, an L bend, an M bend, a βA strand, a βB strand, a βC strand, a βD strand, a βE strand, a βF strand, an A turn, a B turn, a C turn, and a βA bridge linked one to another by loop regions. The globular temperature sensing domain has a sequence (SEQ ID NO: 457)
$X_1$-$X_2$-$X_3$-$X_4$-$X_5$-$X_6$-$X_7$-$X_8$-$X_9$-$X_{10}$-$X_{11}$-$X_{12}$-$X_{13}$-$X_{14}$-$X_{15}$-$X_{16}$-

$X_{17}$-$X_{18}$-$X_{19}$-$X_{20}$-$X_{21}$-$X_{22}$-$X_{23}$-$X_{24}$-$X_{25}$-$X_{26}$-$X_{27}$-$X_{28}$-$X_{29}$-$X_{30}$-$X_{31}$-

$X_{32}$-$X_{33}$-$X_{34}$-$X_{35}$-$X_{36}$-$X_{37}$-$X_{38}$-$X_{39}$-$X_{40}$-$X_{41}$-$X_{42}$-$X_{43}$-$X_{44}$-$X_{45}$-$X_{46}$-

$X_{47}$-$X_{48}$-$X_{49}$-$X_{50}$-$X_{51}$-$X_{52}$-$X_{53}$-$X_{54}$-$X_{55}$-$X_{56}$-$X_{57}$-$X_{58}$-$X_{59}$-$X_{60}$-$X_{61}$-

$X_{62}$-$X_{63}$-$X_{64}$-$X_{65}$-$X_{66}$-$X_{67}$-$X_{68}$-$X_{69}$-$X_{70}$-$X_{71}$-$X_{72}$-$X_{73}$-$X_{74}$-$X_{75}$-$X_{76}$-

$X_{77}$-$X_{78}$-$X_{79}$-$X_{80}$-$X_{81}$-$X_{82}$-$X_{83}$-$X_{84}$-$X_{85}$-$X_{86}$-$X_{87}$-$X_{88}$-$X_{89}$-$X_{90}$-$X_{91}$-

$X_{92}$-$X_{93}$-$X_{94}$-$X_{95}$-$X_{96}$-$X_{97}$-$X_{98}$-$X_{99}$-$X_{100}$-$X_{101}$-$X_{102}$-$X_{103}$-$X_{104}$-$X_{105}$ wherein
$X_1$ can be a polar residue defining an N-terminal residue;
$X_2$ can be a polar residue forming the A bend;
$X_3$ to $X_5$ can be polar or charged residues forming a loop;
$X_6$ to $X_8$ can be polar amino acids forming the B bend;
$X_9$ can be polar amino acid forming a loop;
$X_{10}$ to $X_{13}$ can be any amino acids forming the βA strand;
$X_{14}$ to $X_{15}$ can be any amino acids forming a loop;
$X_{16}$ to $X_{19}$ can be polar residues forming the C bend;
$X_{20}$ to $X_{22}$ can be polar or non-polar amino acids forming a loop;
$X_{23}$ to $X_{24}$ can be polar amino acid residues forming the D bend;
$X_{25}$ can be a non-polar amino acid forming a loop;
$X_{26}$ to $X_{27}$ can be polar or ionic amino acids forming the E bend;
$X_{28}$ to $X_{30}$ can be polar or non-polar amino acids forming a loop;
$X_{31}$ to $X_{32}$ can be polar, non-polar or ionic amino acids forming the F bend;
$X_{33}$ can be any amino acid forming a loop;
$X_{34}$ to $X_{37}$ can be non-polar amino acids forming the βB strand;
$X_{38}$ to $X_{39}$ can be any amino acids forming a loop;
$X_{40}$ to $X_{41}$ can be any amino acids forming the G bend;
$X_{42}$ to $X_{44}$ can be any amino acids forming a loop;
$X_{45}$ to $X_{46}$ can be any amino acids forming the A turn;
$X_{47}$ can be a non-polar amino acid forming the H bend;
$X_{48}$ to $X_{52}$ can be polar, non-polar, or ionic amino acids forming the βC strand;
$X_{53}$ can be any amino acid forming the I bend;
$X_{54}$ to $X_{56}$ can be any amino acids forming the B turn;
$X_{57}$ to $X_{60}$ can be any amino acids forming a loop;
$X_{61}$ to $X_{64}$ can be any amino acids forming the βD strand;
$X_{65}$ to $X_{66}$ can be any amino acids forming a loop;
$X_{67}$ to $X_{69}$ can be any amino acids forming the J bend;
$X_{70}$ can be any amino acids forming a loop;
$X_{71}$ to $X_{73}$ can be any amino acids forming the βE strand;
$X_{74}$ can be any amino acid forming a loop;
$X_{75}$ to $X_{76}$ can be any amino acids forming the K bend;
$X_{77}$ to $X_{78}$ can be polar amino acids forming the C turn;
$X_{79}$ can be a polar amino acid forming the L bend;
$X_{80}$ to $X_{81}$ can be polar amino acids forming a loop;
$X_{82}$ can be a polar amino acid forming the βA bridge;
$X_{83}$ to $X_{88}$ can be polar amino acids forming a loop;
$X_{89}$ to $X_{96}$ can be polar or ionic amino acid residues forming the βF strand;
$X_{97}$ to $X_{100}$ can be polar or non-polar amino acids forming a loop;
$X_{101}$ to $X_{103}$ can be polar amino acids forming the M bend;
$X_{104}$ to $X_{105}$ can be polar or non-polar amino acids defining a C-terminal segment,
or a variant thereof in which any of the amino acid residues of SEQ ID NO: 457 is substituted with a ΔΔG of substitution greater than −0.5 Rosetta Energy Unit (R.E.U) or lower than −0.5 Rosetta Energy Unit (R.E.U).

In the globular temperature sensitive transcription factor, the temperature sensing domain has a melting temperature Tm defining a bioswitch temperature of the temperature sensitive transcription factor (Tbs), the Tbs being a temperature of the target environment at which the temperature sensitive transcription factor is converted from the DNA bound state to the DNA unbound state, with Tbs=Tm+0° C. to 5° C.

In some embodiments, each monomer protein of the globular temperature sensitive transcription factor is engineered to replace at least one amino acid residue of the temperature sensing domain to have a reduction or an increase in the melting temperature Tm to provide temperature sensitive transcription factors with an increased or decreased Tbs.

According to a third aspect, a method and variants obtainable thereby are described, the method directed to modify a bioswitch temperature Tbs of a coiled coil temperature sensitive transcription factor herein described in a target environment, the coiled coil temperature sensitive transcription factor comprising a coiled coil temperature sensing domain with a melting temperature Tm with Tbs=Tm+0° C. to 5° C., the method comprising:

providing a coiled coil temperature sensitive transcription factor herein described having a starting bioswitch temperature $Tbs_0$ in the target environment and two monomer proteins configured to form a temperature sensing domain in the target environment with a starting melting temperature $Tm_0$; and replacing in at least one monomer protein of the two monomer proteins forming the temperature sensing domain at least one of a hydrophobic amino acid in position a and a hydrophobic amino acid in position d of at least one heptad repeat in the temperature sensitive amino acid sequence of the at least one monomer with residues configured to increase or decrease hydrophobic packing between corresponding amino acid residues in positions a and/or d of corresponding heptad repeats in monomer proteins of the temperature sensing domain, at least one of a polar or charged amino acid in position b, a polar or charged amino acid in position e, and a polar or charged amino acid in position g of at least one heptad repeat in the temperature sensitive amino acid sequence of the at least one monomer with a hydrophobic residue, and/or at least one of a polar or charged amino acid in position e, and a polar or charged amino acid in a position g of at least one heptad repeat in the temperature sensitive amino acid sequence of the at least one monomer with a residue configured to increase or decrease coulombic repulsion between corresponding amino acid residues in positions a, d, e and/or g of corresponding heptad repeats in monomer proteins of the temperature sensing domain, the replacing performed to obtain a variant of the coiled coil temperature sensitive transcription factor with a melting temperature of the temperature sensing domain $Tm_m$ lower or higher than $Tm_0$ in the target environment, the obtained variant having a bioswitch temperature $Tbs_m$ lower or higher than $Tbs_0$ in the target environment.

According to a fourth aspect a method and variants obtainable thereby, the method directed to modify a bioswitch temperature Tbs of a globular temperature sensitive transcription factor herein described in a target environment, the globular temperature sensitive transcription factor comprising a globular temperature sensing domain with a melting temperature Tm with Tbs=Tm+0° C. to 5° C., the method comprising:

providing a globular temperature sensitive transcription factor herein described having a starting bioswitch temperature $Tbs_0$ in the target environment and two monomer proteins configured to form a globular temperature sensing domain in the target environment with a starting melting temperature $Tm_0$; and replacing in at least one monomer protein of the two monomer proteins forming the temperature sensing domain, at least one amino acid residue located in the globular temperature sensing domain interface between the two monomer proteins selected from $X_1$, $X_2$, $X_{20}$ to $X_{22}$, $X_{25}$, $X_{28}$ to $X_{30}$, $X_{31}$ to $X_{32}$, $X_{34}$ to $X_{37}$, $X_{47}$, $X_{48}$ to $X_{52}$, $X_{77}$ to $X_{78}$, $X_{79}$, $X_{80}$ to $X_{81}$, $X_{82}$, $X_{83}$ to $X_{88}$, $X_{89}$ to $X_{96}$, $X_{97}$ to $X_{100}$, and $X_{104}$ to $X_{105}$, and/or at least one solvent exposed amino acid residue selected from $X_3$ to $X_5$, $X_6$ to $X_8$, $X_9$, $X_{16}$ to $X_{17}$, $X_{23}$ to $X_{24}$, $X_{42}$ to $X_{44}$, $X_{45}$ to $X_{46}$, $X_{53}$, $X_{54}$ to $X_{56}$, $X_{57}$ to $X_{60}$, $X_{67}$ to $X_{69}$, and $X_{70}$.

the replacing performed to obtain a variant of the globular temperature sensitive transcription factor with a melting temperature of the temperature sensing domain $Tm_m$ lower or higher than $Tm_0$ in the target environment, the obtained variant having a bioswitch temperature $Tbs_m$ lower or higher than $Tbs_0$ in the target environment.

According to a fifth aspect, an expression vector is described. The expression vector comprises a polynucleotide encoding for one or more temperature sensitive transcription factors herein described, the polynucleotide is comprised in the expression vector under control of one or more regulatory sequence regions in a configuration allowing to express the one or more temperature sensitive transcription factors encoded by the polynucleotide in presence of suitable cellular transcription and translation factors. In some embodiments, the vector can further comprise a target DNA polynucleotide having a DNA coding region under control of a DNA regulatory region, and the temperature sensitive transcription factor is configured to have a DNA-bound state and a DNA-unbound state with respect to specific binding of the dimer to the target DNA polynucleotide in a target environment.

According to a sixth aspect, a temperature sensitive genetic circuit is described to be operated in a target environment at at least two target temperatures. The temperature sensitive genetic circuit comprises one or more molecular components connected one to another by biochemical reactions according to a circuit design. In the temperature sensitive genetic circuit, at least one of the molecular components is a temperature sensitive genetic molecular component comprising a coiled coil and/or globular temperature sensitive transcription factor herein described having a bioswitch temperature Tbs in the target environment equal to one of the at least two target temperatures. In the temperature sensitive genetic circuit, each of the temperature sensitive genetic molecular component is configured to activate or inhibit another molecular component of the genetic circuit at a temperature sensitive molecular component bioswitch temperature equal to the bioswitch temperature Tbs of the coiled coil and/or globular temperature sensitive transcription factor.

According to a seventh aspect, a temperature sensitive multiplexed genetic circuit is described to be operated in a target environment at at least two different target temperatures. The temperature sensitive multiplexed genetic circuit comprises one or more molecular components connected one to another by biochemical reactions according to a circuit design. In the multiplexed genetic circuit at least two genetic molecular components are temperature sensitive molecular components, each configured to activate or inhibit another molecular component of the genetic circuit at a temperature sensitive molecular component bioswitch temperature.

In the multiplexed temperature sensitive genetic circuit, at least one first temperature sensitive molecular component is configured to activate or inhibit a first another molecular component at a first bioswitch temperature $Tbs_1$, and at least one second temperature sensitive molecular component configured to activate or inhibit a second another molecular component at a second bioswitch temperature $Tbs_2$. In the multiplexed genetic circuit the first bioswitch temperature $Tbs_1$ is equal to one of the at least two different target temperatures of the target environment and the second bioswitch temperature $Tbs_2$ is equal to another one of the at least two different target temperatures of the target environment. In the multiplexed genetic circuit, the first another molecular component is different from the second another molecular component and the first bioswitch temperature $Tbs_1$ is different from the second bioswitch temperature Tbs$_2$. In some embodiments at least one of the temperature sensitive genetic molecular components comprises a coiled coil and/or globular temperature sensitive transcription factor herein described having a bioswitch temperature Tbs equal to Tbs$_1$, or Tbs$_2$.

According to an eighth aspect, a temperature sensitive bandpass filter is described to be operated in a target environment at at least three two target temperatures forming a target temperature range, The bandpass filter is configured to be operated within genetic circuit comprising one or more molecular components connected one to another by biochemical reactions according to a circuit design. The temperature sensitive bandpass filter comprises a first temperature sensitive genetic molecular component configured to activate a first itself and/or a first another molecular component of the genetic circuit at a first bioswitch temperature Tbs1 and to inhibit the first another genetic molecular component at a second bioswitch temperature Tbs$_2$. The temperature sensitive bandpass filter further comprises a second temperature sensitive genetic molecular components configured to inhibit the first temperature sensitive molecular component and/or the first another molecular component and to activate or inhibit a second another molecular component of the genetic circuit at the second bioswitch temperature Tbs2.

In the temperature sensitive bandpass filter, the first bioswitch temperature Tbs$_1$ is equal to one of the at least two different target temperatures of the target environment, the second bioswitch temperature Tbs$_2$ is equal to another one of the at least two different target temperatures of the target environment. In the bandpass genetic circuit, the first another molecular component is different from the second another molecular component and the first bioswitch temperature Tbs$_1$, is different form the second bioswitch temperature Tbs$_2$. In some embodiments at least one of the temperature sensitive genetic molecular components comprises a coiled coil and/or globular temperature sensitive transcription factor herein described having a bioswitch temperature Tbs equal to Tbs$_1$, or Tbs$_2$.

According to a ninth aspect, a temperature sensitive cell is described to be operated in a target environment at at least two target temperatures. The temperature sensitive cell comprises a temperature sensitive genetic circuit herein described. In the temperature sensitive genetic circuit, at least one of the genetic molecular components is a temperature sensitive genetic molecular components, each having a bioswitch temperature Tbs$_C$ in the cell equal to at least one of the at least two target temperatures. In some embodiments at least one of the temperature sensitive genetic molecular components comprises a coiled coil and/or globular temperature sensitive transcription factor herein described having a bioswitch temperature Tbs equal to Tbs$_C$.

According to a tenth aspect, a temperature-sensitive therapeutic cell is described. The temperature-responsive therapeutic cell comprises a temperature sensitive genetic circuit herein described comprising at least one temperature sensitive molecular component and at least one therapeutic molecular component. In the genetic circuit of the therapeutic cell, the at least one temperature sensitive molecular components is configured to activate or inhibit the at least one therapeutic molecular component at a therapeutic bioswitch temperature Tbs$_T$ In some embodiments bioswitch temperature Tbs$_T$ is achieved in the temperature sensitive therapeutic cell in response to a thermal stimulus. In some embodiments, the thermal stimulus is selected from a host fever or external source of thermal energy such as focused ultrasound, infrared, magnetic particle hyperthermia. In some embodiments at least one of the temperature sensitive genetic molecular components comprises a coiled coil and/or globular temperature sensitive transcription factor herein described having a bioswitch temperature Tbs equal to Tbs$_T$.

According to a eleventh aspect, a temperature sensitive inactivable cell is described comprising a temperature sensitive genetic circuit herein described in which at least one temperature sensitive molecular component is configured to activate or inhibit at least one killer molecular component at an inactivating bioswitch temperature Tbs$_T$ In some embodiments the inactivating bioswitch temperature Tbs$_i$ is achieved in the temperature sensitive therapeutic cell in response to a decrease in the cell temperature associated with a spatial translocation of the temperature sensitive inactivable cell. In some embodiments at least one of the temperature sensitive genetic molecular components comprises a coiled coil and/or globular temperature sensitive transcription factor herein described having a bioswitch temperature Tbs equal to Tbs$_T$.

According to a twelfth aspect, a composition is described. The composition comprises one or more coiled coil and/or globular temperature sensitive transcription factors, vectors, genetic circuit and/or temperature sensitive cells herein described together with a suitable vehicle.

According to a thirteen aspect, a method to control a biological process in an individual is described. The method comprises administering to the individual one or more temperature sensitive cells herein described comprising a temperature sensitive genetic circuit herein described. In the method the temperature sensitive genetic circuit is configured to provide an output interfering with the biological process in the individual at a set target temperature between 34° C. and 44° C.

According to a fourteenth aspect, a method to treat a condition in an individual, is described. The method comprises administering to the individual one or more therapeutic temperature sensitive cells herein described comprising a temperature sensitive genetic circuit herein described. In the method the temperature sensitive genetic circuit is configured to provide a therapeutic output in the individual at a set target temperature between 34° C. and 44° C.

According to a fifteenth aspect, a method to control cell viability in a temperature sensitive manner is described. The method comprises providing a temperature sensitive cell comprising one or more temperature sensitive genetic circuits herein described comprising at least one temperature sensitive molecular component configured to activate at least one killer molecular component at an inactivating bioswitch temperature Tbs$_I$, The method also comprises applying to the temperature sensitive cell the inactivating bioswitch temperature Tbs$_I$ for time and under condition to allow activation of the at least one killer components by the at least one temperature sensitive molecular component and to result in death of the temperature sensitive cell.

In some embodiments of the temperature sensitive transcription factors, genetic circuits, vectors, cells, and related methods and systems a target temperature of the environment Tbs can be selected from 34 to 41<33° C. (including ambient environment), 33-34° C. (including skin temperature) 34-36° C. (including hypothermic core temperature), 36-38° C. (including human physiological temperature), 38-40° C. (including mild fever in humans, 40° C.-42° C. (including severe fever in humans), 39° C.-45° C. (including applied hyperthermia in humans (e.g. HIFU))

Temperature sensitive transcription factors, genetic circuit, cells and related vectors compositions, methods and systems herein described, allow in several embodiments to spatially and/or temporally control activation of cellular functions in a cell through a thermally regulated coupling of endogenous or applied signals to cellular function.

Temperature sensitive transcription factors, genetic circuit, cells and related vectors compositions, methods and systems herein described, allow in several embodiments to spatially and/or temporally control activation of cellular functions of a systemically administered microbial therapy to a specific anatomical site, such as a deep-seated tumor or section of the gastrointestinal tract that would be difficult to reach with other triggers (e.g. optogenetic).

Temperature sensitive transcription factors, genetic circuit, cells and related vectors compositions, methods and systems herein described, allow in several embodiments to locally target therapeutic effects of cell therapy provided via systemic administration, minimizing the related side effects.

Temperature sensitive transcription factors, genetic circuit, cells and related vectors compositions, methods and systems herein described, allow in several embodiments to combine thermally-triggered gene expression in vivo with genetically encoded genomic or proteomic tools to enable the study of cellular signaling within the context of mammalian hosts.

Temperature sensitive transcription factors, genetic circuit, cells and related vectors compositions, methods and systems herein described, allow in several embodiments to program controlled responses to mammalian host temperature, (e.g. production of a therapeutic agent by a temperature sensitive cell in response to a host fever or runaway inflammation, or expression a therapeutic gene by a temperature sensitive cell only within a specified temperature range).

Temperature sensitive transcription factors, genetic circuit, cells and related vectors compositions, methods and systems herein described, allow in several embodiments to restrict bacterial viability within a thermal range (e.g. to confine the activity of genetically engineered microbes to the in vivo environment of a mammalian host and thereby limit the potential for environmental contamination, or to obtain a greater efficiency of multilayered and multi-input containment circuits in preventing mutational escape).

Temperature sensitive transcription factors, genetic circuit, cells and related vectors compositions, methods and systems herein described, can be used in connection with various applications wherein controlled output of a genetic circuit is desired. For example, temperature sensitive transcription factors, genetic circuit, cells and related vectors compositions, methods and systems herein described can be used to provide spatially and/or temporally controlled expression of therapeutics in medical applications, drug research and manufacturing, biological synthesis of chemicals and proteins such as enzymes or catalysts or polymers, as well diagnostics and/or clinical applications. Additional exemplary applications include uses of temperature sensitive transcription factors, genetic circuit, cells and related vectors compositions, methods and systems in several fields including basic biology research, applied biology, bio-engineering, bio-energy, medical research, medical diagnostics, therapeutics, bio-fuels, and in additional fields identifiable by a skilled person upon reading of the present disclosure.

The details of one or more embodiments of the disclosure are set forth in the accompanying drawings and the description below. Other features, objects, and advantages will be apparent from the description and drawings, and from the claims.

BRIEF DESCRIPTION OF DRAWINGS

The accompanying drawings, which are incorporated into and constitute a part of this specification, illustrate one or more embodiments of the present disclosure and, together with the detailed description and the examples, serve to explain the principles and implementations of the disclosure.

FIG. 2(a) shows diagrams of examples of constructs used to assay the performance of temperature sensitive repressors (TSR, top) and heat shock promoters (HSP, bottom), where large arrows indicate expressed genes (green fluorescent protein, GFP; TSR) and small arrows indicate promoters (pTSR, pLacI, pHSP). 'T7 term' and a 'T' symbol indicate a T7 RNA polymerase transcriptional terminator. The 'flat-headed line' symbol above the pTSR promoter indicates transcriptional repression by TSR. The specific repressors and promoters assayed are listed to the right of the diagrams of expression constructs. The illustration of bacteria before and after a temperature change (ΔT) depicts de-repression of a thermally-gated promoter and expression of GFP. FIG. 2(b) shows a graph of examples of OD-normalized fluorescence (normalized fluorescence units, NFU) after 12 hours of thermal induction for the constructs shown in FIG. 2(a). Minimum fluorescence ($F_{min}$) represents expression at 31.4° C. $F_{max}$ is the maximum fluorescence intensity measured for each construct, measured up to 45.7° C. The fold change between $F_{min}$ and $F_{max}$ is shown above each sample. Where not seen, error bars are smaller than the symbol. N=4 for TSRs and N=3 for HSPs. *The TcI $F_{min}$ is reported from measurement at 34.2° C. because expression at lower temperatures was below the detection limit of the assay. FIG. 2(c) shows a graph of exemplary OD-normalized fluorescence from the TlpA- and TcI-regulated constructs as a function of induction temperature for a fixed duration of 12 hours. FIG. 2(d) shows a graph of exemplary OD-normalized fluorescence as a function of thermal induction duration at the maximal induction temperature for the TlpA and TcI constructs. FIG. 2(e) and FIG. 2(f) show images of examples of OD-normalized fluorescence landscapes for TlpA and TcI-gated constructs, respectively, as a function of both incubation temperature and duration, where data shown are interpolated from an 8×8 sampling matrix of these variables. All samples in FIG. 2(d)-(f) were maintained at 30° C. after the indicated period of thermal induction for a total experimental duration of 24 hours prior to measurement.

FIG. 3(a) shows a graph of National Center for Biotechnology Information (NCBI) Basic Local Alignment Search Tool (BLAST) search results for the wild type tlpA, cI, tetR, and lacI genes showing the cumulative number of hits obtained. The NCBI nucleotide collection was searched with the source organism restricted to bacteria. Cloning vectors, synthetic constructs, and individual gene sequences were omitted; genomic and naturally occurring plasmid sequences were retained. Sequences with alignment lengths of less than 90% of the wild type protein sequence were not included. The lacI gene is distributed throughout many commonly utilized $E.$ $coli$ strains such as Nissle 1917 and BL21, whereas the cI gene is found in less widely used $E.$ $coli$ strains. FIG. 3(b) shows a graph of examples of the number of bacterial species in which the selected repressors are found. Data were obtained as in FIG. 3(a) and substrains were binned together. TlpA is largely restricted to $S.$ $enterica$ and cI to $E.$ $coli$; tetR and lacI can be found in a larger number of bacterial species.

FIG. 4(a) shows a graph of exemplary OD-normalized expression of the GFP reporter gene under the control of TlpA, LacI$^q$, and TlpA$_{SP}$ (in which nucleotides within the Pribnow box of the operator are shuffled) at the indicated temperatures. FIG. 4(b) shows an image of a gel showing exemplary results of an electromobility shift assay using a FAM-labeled pTlpA operator oligonucleotide visualized with blue epifluorescence illumination. The bands in lanes 3 and 5 indicated by white arrowheads represent pTlpA oligonucleotides bound to the $E.$ $coli$ $\sigma^{70}$-RNAp holoenzyme and TlpA, respectively, demonstrating association of the operator with both the $E.$ $coli$ $\sigma^{70}$-RNAp holoenzyme and TlpA. In contrast, scrambled TlpA operator (shown in lanes 4 and 6) fails to associate with these proteins. The TlpA and $\sigma^{70}$-RNAp concentrations used in this experiment (1 μM and 0.18 μM, respectively) were similar to previous literature[1, 2]. FIG. 4(c) shows a graph of exemplary GFP expression driven by the TlpA operator in the canonical (Forward) and flipped (Reverse) orientations at 44.1° C. FIG. 4(d) shows a graph of exemplary thermal induction profiles for GFP expression under the control of forward and reverse-oriented TlpA operator, where each curve is self-normalized to its maximal fluorescence intensity. FIG. 4(e) shows a diagram of the proposed mechanism of TlpA-based thermal transcriptional regulation. The illustration on the left side of the diagram shows the association of a dimer of TlpA repressor with the TlpA operator, at temperatures below the de-repression temperature, preventing the association of the $\sigma^{70}$-RNAp holoenzyme with the TlpA operator containing a Pribnow box. An increase in temperature (ΔT) is proposed to cause an unwinding of the coiled coil domain of TlpA (shown on the right side of the diagram) and dissociation of TlpA from the TlpA operator, permitting association of the $\sigma^{70}$-RNAp holoenzyme with the TlpA operator, regulating strong transcription from the forward orientation of the promoter and weak transcription in the reverse orientation.

FIG. 6(a) shows examples of fluorescent images of replica plates used to screen for TlpA variants turning on between 37° C. and 40° C. One colony selected for further analysis is indicated by an arrow and a pair of circles around the colony replica plated and incubated at the two temperatures. FIG. 6(b) shows a scatter plot of examples of TlpA variants plotted by their measured midpoint transition temperatures ($T_m$) and 10%-90% transition range ($T_{10-90}$), estimated by linear interpolation. The shade of grey of each data point maps to the change in fluorescence over the $T_{10-90}$ span. FIG. 6(c) shows a graph of exemplary OD-normalized fluorescence of novel TlpA variants. OD-normalized fluorescence values of TlpA variants are also normalized to wild-type, with the maximal wild-type value given a value of 1.0. FIG. 6(d) shows a graph of exemplary OD-normalized fluorescence of novel TcI variants normalized to wild-type. Scale bars 1 cm.

FIG. 7(a) shows a schematic of exemplary mutation positions within the predicted domain structure of TlpA$_{36}$ (P60L, D135V, K187R, K202I, L208Q) and TlpA$_{39}$ (D135V, A217V, L236F) The DNA binding domain is depicted in dark grey and coiled-coil domain in light grey, as delineated by Koski et al[3]. The figure is drawn to the scale of the primary sequence. FIG. 7(b) shows 'helical wheel' diagrams of positions of mutations in TlpA$_{36}$ within the predicted structure of the coiled-coil interface as viewed down the long axis of the helix, with two TlpA proteins shown side-by-side, in a predicted dimer configuration of the transcriptionally repressive state. For each helical wheel diagram, a portion of a predicted alpha-helical heptad repeat (labeled a-b-c-d-e-f-g) is shown, connected by progressively thinner straight lines shown in an N-terminal to C-terminal direction. A dashed line is shown between the 'g' of a heptad and the 'a' of a next heptad in a portion of the heptad repeat. Each helical wheel diagram shown depicts three consecutive heptads, with three single-letter amino acid symbols shown circled at each position in a heptad. The sequence of amino acids in an N-terminal to C-terminal direction are shown at each position of a heptad, with the first heptad in the portion of the heptad repeat shown on the line of each large circle representing each alpha-helix; the amino acids of the second consecutive heptad are shown further out from the large circle, and the third consecutive heptad are shown outermost from each large circle. The lines comprised of small 'x' symbols in the middle diagram of FIG. 7(b) indicate predictive inter-monomeric repulsive ionic interaction between the indicated R and K residues; all inter-monomeric dashed lines represent predicted energetically favorable ionic interactions. The coil register was assigned based on consensus between previous literature [3] and the structure prediction servers COILS[4], Paircoil2[5], and LOGICOIL[6]. The images were produced using Draw-Coil 1.0[7]. The P60L mutation is not shown because it falls outside of the predicted coiled-coil region. FIG. 7(c) shows 'helical wheel' diagrams of positions of mutations in TlpA$_{39}$. Heptad repeat register prediction and illustration were performed as in FIG. 7(b). FIG. 7(g) shows a crystal structure model image depicting mutation positions (spheres) for the lambda repressor variant TcI$_{38}$. FIG. 7(h) shows a crystal structure model image depicting mutation positions (spheres) within the TcI$_{42}$ variant.

FIG. 10(a) shows an illustration of an example of an experiment showing fever-induced gene expression activation using a thermal bioswitch and an example of a thermal logic circuit diagram of a corresponding E. coli construct. In the illustration, a mouse is administered with a bacterium transformed with a plasmid comprising GFP regulated by TplA$_3$, which represses GFP expression at sub-fever temperature. After induction of fever (arrow) GFP expression is de-repressed, shown by a grey shaded area within the dotted circle in the mouse on the right. In the thermal logic circuit diagram, large arrows indicate expressed genes (GFP, tlpA$_{36}$) and small arrows indicate promoters (pTlpA, pLacI). 'T7 term' and a 'T' symbol indicate a T7 RNA polymerase transcriptional terminator. The 'flat-headed line' symbol above the pTlpA promoter indicates transcriptional repression by TlpA$_{36}$. FIG. 10(b) shows an exemplary image of a thresholded fluorescence map of a mouse that underwent fever induction after being injected subcutaneously with plasmids expressing TlpA$_{36}$- and TlpA$_{wt}$-regulated GFP into the left and right hind limbs, respectively, showing a spot of fluorescence on the left hindlimb. The highest fluorescence level (black area in center of the spot) is surrounded by a light grey circle at the penumbra, corresponding to a gradient of injected bacterial concentration (highest at the center). FIG. 10(c) shows an exemplary image of a thresholded fluorescence map of a mouse that was prepared identically to the animal in FIG. 10(b), but maintained at room temperature, and does not show a fluorescent spot in the left hindlimb. FIG. 10(d) shows an illustration of an example of a temperature-based host confinement strategy, and an exemplary circuit diagram of a thermal kill switch permitting bacterial survival only at temperatures above 36° C. In the illustration, a mouse is administered into the gastrointestinal tract with a bacterium transformed with a plasmid comprising a construct in which antitoxin CcdA fused to a degradation tag ssrA (encoded by ccdA-ssrA) expression is de-repressed by TlpA$_{36}$. Within the mouse gut, at 37° C., antitoxin expression is de-repressed and the bacterium is alive. Following defecation (arrow; fecal pellets represented by dark ovals), decreased temperature outside of the mouse (25° C.) results in repression of antitoxin expression and death of the bacteria resulting from the expressed toxin CcdB (encoded by ccdB). In the thermal logic circuit diagram, large arrows indicate expressed genes (CmR, ccdB, tlpA$_{36}$, and ccdA-ssrA) and small arrows indicate promoters (constitutive promoter lac UV5; pTlpA). 'T7 term' and a 'T' symbol indicate a T7 RNA polymerase transcriptional terminator. The 'flat-headed line' symbol above the pTlpA promoter indicates transcriptional repression by TlpA$_{36}$. CmR is used to reduce the expression of the promoter and the weak RBS is used to reduce leakiness of CcdA expression and reduce toxin CcdB expression to prevent mutations FIG. 10(e) shows an example of a graph of colony counts from liquid cultures (colony forming units, CFU, per mL of culture) of killswitch-containing cells and controls (containing no toxin system) after 24 hours of incubation at the indicated temperature. P-value=0.0002 for kill switch vs. control cells at 25° C. and p<0.0001 for kill switch at 25° C. versus 37° C. FIG. 10(f) shows an example of a graph of colony counts in fecal samples freshly collected from N=5 mice 5 hours after oral gavage of killswitch-containing E. coli or controls. The feces were incubated at a temperature representative of post-defecation conditions (25° C.), or incubated at 37° C. (Rescue). P-value=0.0067 for kill switch vs. control cells at 25° C. and p=0.0275 for kill switch at 25° C. versus 37° C. Scale bars 1 cm.

FIG. 11 shows the DNA and protein sequence of TlpA. FIG. 11(a) shows the DNA sequence (SEQ ID NO: 460). FIG. 11(b) shows the single-letter amino acid code sequence of TlpA protein (SEQ ID NO: 461). Bold underlined amino acid residues are mutated in the TlpA$_{36}$ variant, italic underlined residues are mutated in the TlpA$_{39}$ variant, and the lowercase underlined amino acid residue is mutated in both the TlpA$_{36}$ variant and the TlpA$_{39}$ variant. The '*' symbol represents the stop codon at the C-terminus of the protein FIG. 12 shows the DNA and protein sequence of the TlpA$_{36}$ variant. FIG. 12(a) shows the DNA sequence (SEQ ID NO: 462). FIG. 12(b) shows the single-letter amino acid code sequence of TlpA$_{36}$ protein (SEQ ID NO: 463). The '*' symbol represents stop codon at the C-terminus of the protein FIG. 13 shows the DNA and protein sequence of the TlpA$_{39}$ variant. FIG. 13(a) shows the DNA sequence (SEQ ID NO: 464). FIG. 13(b) shows the single-letter amino acid code sequence of TlpA$_{39}$ protein (SEQ ID NO: 465). The '*' symbol represents stop codon at the C-terminus of the protein

FIG. 15 shows the amino acid sequence of TlpA divided into heptad repeat portions 'A' through 'M' in the predicted coiled-coil domain, with the coil register of heptads assigned based on consensus between previous literature [3] and the structure prediction servers Paircoil2[5] and LOGICOIL[6], as shown in FIG. 14. In particular, FIG. 15 shows DNA binding domain residues 1 to 69 (SEQ ID NO:472), Heptad repeat 'A' residues 70 to 92 (SEQ ID NO:473), Heptad repeat 'B' residues 93 to 108 (SEQ ID NO:474), Heptad repeat 'C' residues 109 to 152 (SEQ ID NO: 475), Heptad repeat 'D' residues 155 to 178 (SEQ ID NO:476), Heptad repeat 'E' residues 180 to 193 (SEQ ID NO:477), Heptad repeat 'F' residues 194 to 198 (SEQ ID NO:478), Heptad repeat 'G' residues 199 to 221 (SEQ ID NO:479), Heptad repeat 'H' residues 223 to 232 (SEQ ID NO:480), Heptad repeat 'I' residues 233 to 236 (SEQ ID NO:481), Heptad repeat 'J' residues 238 to 253 (SEQ ID NO: 482), Heptad repeat 'K' residues 254 to 262 (SEQ ID NO:483), Heptad repeat 'L' residues 263 to 278 (SEQ ID NO:484), Amino acids between heptad repeats 'L' and 'M' (SEQ ID NO: 485), Heptad repeat 'M' residues 309 to 361 (SEQ ID NO: 486), Amino acids after heptad repeat 'M' (SEQ ID NO: 487). Amino acids that did not fit into a heptad between heptad repeat portions 'A' through 'M' and also following heptad repeat portion 'M' are indicated with "doesn't fit to heptad". The predicted DNA binding domain is also indicated (residues 1 to 69).

FIG. 16 shows 'helical wheel' diagrams of the predicted structure of the TlpA coiled-coil interface as viewed down the long axis of the helix, with two TlpA proteins shown side-by-side, in a predicted dimer configuration of the transcriptionally repressive state. Each helical wheel diagram (FIG. 16(*a*)-(*m*)) shows a portion of the predicted coiled-coil domain, divided into uninterrupted amino acid sequences that are predicted to fit into the same heptad register, according to the sequences listed in FIG. 15, as follows: FIG. 16(*a*) corresponds to FIG. 15 Heptad repeat 'A' (SEQ ID NO:473); FIG. 16(*b*) corresponds to FIG. 15 Heptad repeat 'B' (SEQ ID NO:474); FIG. 16(*c*) corresponds to FIG. 15 Heptad repeat 'C' (SEQ ID NO: 475); FIG. 16(*d*) corresponds to FIG. 15 Heptad repeat 'D' (SEQ ID NO:476); FIG. 16(*e*) corresponds to FIG. 15 Heptad repeat 'E' (SEQ ID NO:477); FIG. 16(*f*) corresponds to FIG. 15 Heptad repeat 'F' (SEQ ID NO:478); FIG. 16(*g*) corresponds to FIG. 15 Heptad repeat 'G' (SEQ ID NO:479); FIG. 16(*h*) corresponds to FIG. 15 Heptad repeat 'H' (SEQ ID NO:480); FIG. 16(*i*) corresponds to FIG. 15 Heptad repeat 'I' (SEQ ID NO:481); FIG. 16(*j*) corresponds to FIG. 15 Heptad repeat 'J' (SEQ ID NO: 482); FIG. 16(*k*) corresponds to FIG. 15 Heptad repeat 'K' (SEQ ID NO:483); FIG. 16(*l*) corresponds to FIG. 15 Heptad repeat 'L' (SEQ ID NO:484); FIG. 16(*m*) corresponds to FIG. 15 Heptad repeat 'M' (SEQ ID NO: 486). The predicted alpha-helical heptad repeat (labeled a-b-c-d-e-f-g) is shown, connected by progressively thinner straight lines shown in an N-terminal to C-terminal direction. A dashed line is shown between the last residue of a heptad and the first residue of a next heptad in a portion of the heptad repeat. Single-letter amino acid symbols shown circled at each position in a heptad. The sequence of amino acids in an N-terminal to C-terminal direction are shown at each position of a heptad, with the first heptad in the portion of the heptad repeat shown on the line of each large circle representing an alpha-helix, and the amino acids of consecutive heptads are shown further out from the large circle. The coil register was assigned based on consensus between previous literature [3] and the structure prediction servers Paircoil2[5] and LOGICOIL[6]. The images were produced using DrawCoil 1.0[7]. In FIG. 16(*c*),(*d*),(*h*),(*j*), and (*m*), inter-monomeric dashed lines represent predicted energetically favorable ionic interactions. In FIG. 16(*e*), lines comprised of small 'x' indicate predictive repulsive inter-monomeric ionic interaction between the indicated R and K residues. Inter-monomeric dashed lines represent predicted energetically favorable ionic interactions.

FIG. 17 shows residues 1 to 139 of the amino acid sequence of TlpA protein (SEQ ID NO: 488), with amino acids annotated with 'H' on the lower row representing an amino acid that forms part of a predicted heptad repeat of a coiled-coil domain. The secondary structure prediction of TlpA was performed using the software JPred. This software predicts that the DNA binding domain of TlpA consists of three alpha helices separated by short linkers.

FIG. 18 shows the DNA and protein sequence of TcI. FIG. 18(*a*) shows the DNA sequence (SEQ ID NO: 466). FIG. 18(*b*) shows the single-letter amino acid code sequence of TcI protein (SEQ ID NO: 467). Bold underlined amino acid residues are mutated in the $TcI_{38}$ variant, italic underlined residues are mutated in the $TcI_{42}$ variant, and the lowercase underlined amino acid residue is A67T that confers the original temperature sensitivity in the $cI^{857}$ mutant (herein referred to as TcI). The '*' symbol represents the stop codon at the C-terminus of the protein.

FIG. 19 shows the DNA and protein sequence of the $TcI_{38}$ variant. FIG. 19(*a*) shows the DNA sequence (SEQ ID NO: 468). FIG. 19(*b*) shows the single-letter amino acid code sequence of $TcI_{38}$ protein (SEQ ID NO: 469). The '*' symbol represents the stop codon at the C-terminus of the protein.

FIG. 20 shows the DNA and protein sequence of the $TcI_{42}$ variant. FIG. 20(*a*) shows the DNA sequence (SEQ ID NO: 470). FIG. 20(*b*) shows the single-letter amino acid code sequence of $TcI_{42}$ protein (SEQ ID NO: 471). The '*' symbol represents the C-terminus of the protein FIG. 21 shows the amino acid sequence of TcI (SEQ ID NO: 467), highlighting the DNA binding domain (bold), the linker (italicized) and the globular dimerization domain (underlined), based on the crystal structure of the wild type lambda repressor (Protein Data Bank (PDB) code 3BDN) [8]. The '*' symbol represents the stop codon at the C-terminus of the protein.

FIGS. 22(*b-d*) show crystal structures of the individual domains of dimerized TcI, wherein the DNA-binding domain is shown in FIG. 22(*b*), the linker domain is shown in FIG. 22(*c*), and the globular dimerization domain is shown in FIG. 22(*d*).

FIG. 24 shows a Table of physicochemical properties of twenty naturally occurring amino acids, including side-chain class, side chain polarity, side-chain charge (at pH 7.4), hydropathy index [9], and molecular weight (g/mol).

DETAILED DESCRIPTION

Figure 1:
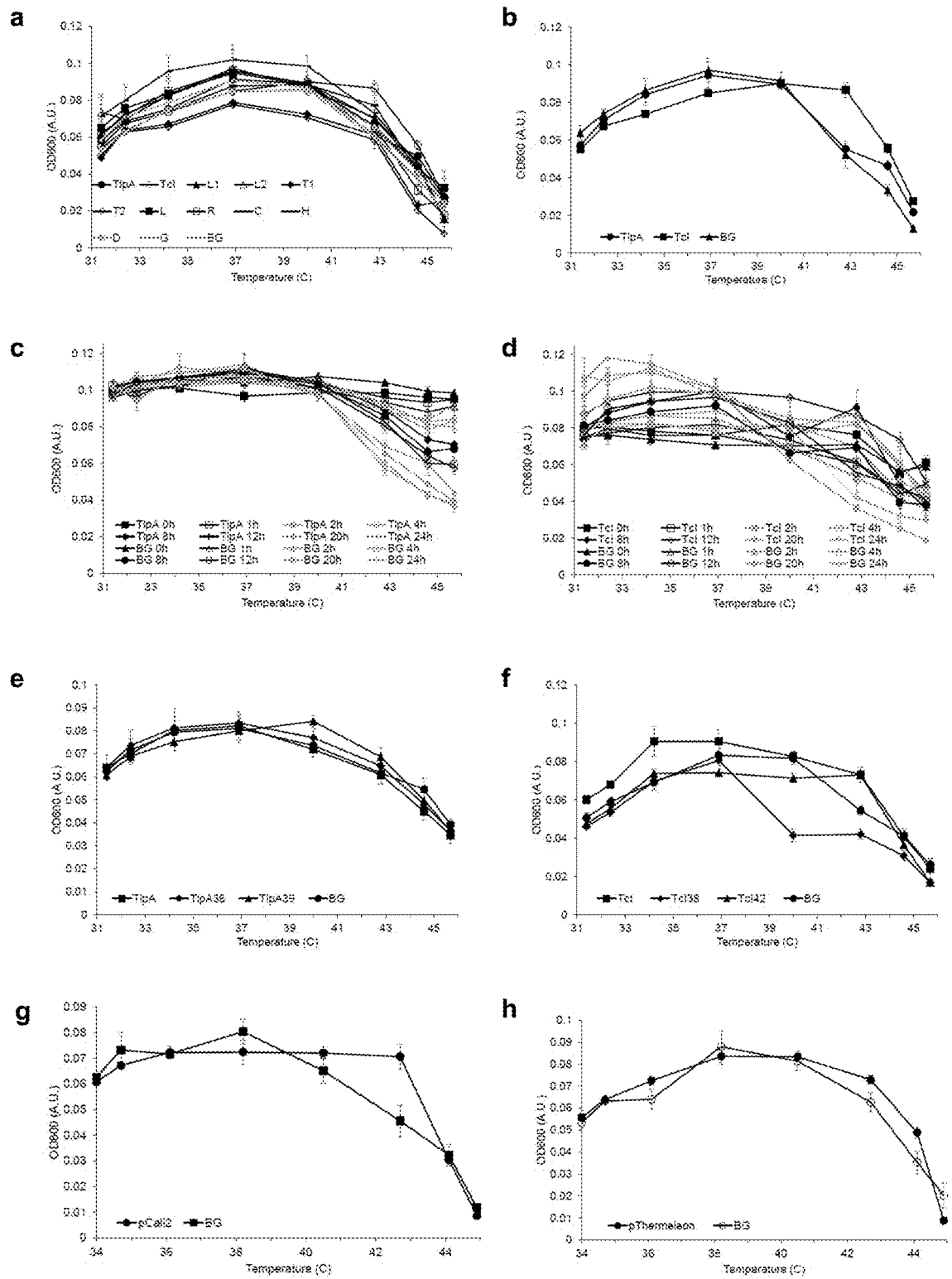
FIG. 1 shows examples of optical density (OD) measurements of cultures of E. coli transformed with the indicated plasmid constructs. OD was measured at at 600 nm, at the indicated temperatures, corresponding to the $OD_{600}$ measurements for thermal induction profiles reported in Examples. Absorbance units (A.U.) of OD shown are blank-subtracted (bacterial culture minus culture media only) measurements of $OD_{600}$ in 90 µL volumes in clear-bottom 96 well plates, corresponding to an optical path length of approximately 1.4 mm. $OD_{600}$ measurements in FIG. 1(a) correspond to FIG. 2(b); $OD_{600}$ measurements in FIG. 1(b) correspond to FIG. 2(c); $OD_{600}$ measurements in FIG. 1(c) correspond to FIG. 2(e); $OD_{600}$ measurements in FIG. 1(d) correspond to FIG. 2(f); $OD_{600}$ measurements in FIG. 1(e) correspond to FIG. 6(d); $OD_{600}$ measurements in FIG. 1(f) correspond to FIG. 6(e); $OD_{600}$ measurements in FIG. 1(g) correspond to FIG. 8(c); $OD_{600}$ measurements in FIG. 1(h) correspond to FIG. 8(g). 'BG' indicates measurement of E. coli transformed with a non-fluorescent construct.

Provided herein are temperature sensitive transcription factors that can be used as thermal transcriptional bio-switches and related gene vectors, genetic circuits, methods and systems.

The term "transcription factor" as used herein indicates a protein capable of controlling transcription of an encoded polynucleotide from DNA to RNA by binding to a DNA regulatory sequence such as an enhancer and/or a promoter or any other DNA segment operably connected to the encoded polynucleotide.

The term "protein" as used herein indicates a polypeptide with a particular secondary and tertiary structure that can interact with another molecule and in particular, with other biomolecules including other proteins, DNA, RNA, lipids, metabolites, hormones, chemokines, and/or small molecules. The term "polypeptide" as used herein indicates an organic linear, circular, or branched polymer composed of two or more amino acid monomers and/or analogs thereof. The term "polypeptide" includes amino acid polymers of any length including full length proteins and peptides, as well as analogs and fragments thereof. A polypeptide of three or more amino acids is also called a protein oligomer, peptide, or oligopeptide. In particular, the terms "peptide" and "oligopeptide" usually indicate a polypeptide with less than 100 amino acid monomers. In particular, in a protein, the polypeptide provides the primary structure of the protein, wherein the term "primary structure" of a protein refers to the sequence of amino acids in the polypeptide chain covalently linked to form the polypeptide polymer. A protein "sequence" indicates the order of the amino acids that form the primary structure. Covalent bonds between amino acids within the primary structure can include peptide bonds or disulfide bonds, and additional bonds identifiable by a skilled person. Polypeptides in the sense of the present disclosure are usually composed of a linear chain of alpha-amino acid residues covalently linked by peptide bond or a synthetic covalent linkage. The two ends of the linear polypeptide chain encompassing the terminal residues and the adjacent segment are referred to as the carboxyl terminus (C-terminus) and the amino terminus (N-terminus) based on the nature of the free group on each extremity. Unless otherwise indicated, counting of residues in a polypeptide is performed from the N-terminal end ($NH_2$-group), which is the end where the amino group is not involved in a peptide bond to the C-terminal end (—COOH group) which is the end where a COOH group is not involved in a peptide bond. Proteins and polypeptides can be identified by x-ray crystallography, direct sequencing, immuno precipitation, and a variety of other methods as understood by a person skilled in the art. Proteins can be provided in vitro or in vivo by several methods identifiable by a skilled person. In some instances where the proteins are synthetic proteins in at least a portion of the polymer two or more amino acid monomers and/or analogs thereof are joined through chemically-mediated condensation of an organic acid (—COOH) and an amine (—$NH_2$) to form an amide bond or a "peptide" bond.

As used herein the term "amino acid", "amino acidic monomer", or "amino acid residue" refers to organic compounds composed of amine and carboxylic acid functional groups, along with a side-chain specific to each amino acid. In particular, alpha- or α-amino acid refers to organic compounds composed of amine (—NH2) and carboxylic acid (—COOH), and a side-chain specific to each amino acid connected to an alpha carbon. Different amino acids have different side chains and have distinctive characteristics, such as charge, polarity, aromaticity, reduction potential, hydrophobicity, and pKa. Amino acids can be covalently linked to form a polymer through peptide bonds by reactions between the amine group of a first amino acid and the carboxylic acid group of a second amino acid. Amino acid in the sense of the disclosure refers to any of the twenty naturally occurring amino acids, non-natural amino acids, and includes both D an L optical isomers.

The term "non-natural amino acids" or "artificial amino acids" indicate not naturally encoded or found in the genetic code of any organisms and typically comprise non-proteinogenic amino acids that either occur naturally or are chemically synthesized. Accordingly, non-natural amino acids comprise molecules that can be coupled together using standard amino acid coupling chemistry, and that have molecular structures that do not resemble the naturally occurring amino acids. Exemplary non-natural amino acids comprise e.g., α,α'-dialkyl-amino acids such as amino isobutyric acid (Aib) or cyclopentyl glycine and analogs of naturally occurring amino acids. The term "amino acid analog" refers to an amino acid in which one or more individual atoms have been replaced, either with a different atom, isotope, or with a different functional group but is otherwise identical to original amino acid from which the analog is derived [10].

Transcription factors in the sense of the disclosure are proteins that control expression of an encoded polynucleotide by binding DNA regulatory sequences alone or in combination with one or more transcription co-factors.

The term "DNA regulatory sequence" as used herein indicates any DNA segment operably connected to an encoded polynucleotide. The terms "operably connected" or "operably linked" between two elements refer to a functional linkage between the two elements, so that functionalities of one element is controlled by the other element. In DNA regulatory sequence a conformation of the DNA segment triggers transcription of the encoded polynucleotide. Operably linked DNA regulatory sequences and encoded polynucleotide can be contiguous or non-contiguous and can comprise polynucleotides in a same or different reading frame. In an embodiment, each of the operably linked polynucleotide can be comprised within a cassette. The cassette can additionally contain at least one additional polynucleotide to be co-expressed with the encoded polynucleotide (e.g. a selectable marker gene). One or more additional genes can also be provided on multiple expression cassettes that can further comprise a plurality of restriction sites and/or recombination sites for insertion of other polynucleotides.

Transcription co-factors in the sense of the disclosure refer to proteins polynucleotides or portions therefore that are configured to control transcription of an encoded polynucleotide in combination with transcription factors, e.g. by binding the transcription factor to form transcription complex. Examples of transcription co-factors that can control transcription in combination with transcription factors in the sense of the disclosure comprise transcriptional or translational controlling factors such CRISPR-CAS systems, siRNA, riboregulators, transcriptional RNA based activators and repressors [11], and other factors identifiable by a skilled person. Transcription factors and transcription cofactor of the disclosure that can be naturally derived, purely synthetically derived, or synthetically derived from natural systems.

Transcription factors in the sense of the disclosure comprise transcription repression factor (also referred to as "repressor") and a transcription activation factor (also referred to as "activator"). The transcription repression factor binds to DNA regulatory sequence to repress the transcription of an encoded polynucleotide, thereby reducing the expression level of the encoded polynucleotide. The transcription activation factor binds to DNA regulatory sequence to promote the transcription of an encoded polynucleotide, thereby increasing the expression level of the encoded polynucleotide. In particular, a transcription regulatory factor has typically at least one DNA-binding domain that can bind to a DNA regulatory sequence such as an enhancer or a promoter. Some transcription factors bind to a DNA promoter sequence near the transcription start site to form the transcription initiation complex. Other transcription factors bind to other regulatory sequences, such as enhancer sequences, and can either stimulate or repress transcription of the related gene. Examples of transcription repression factors include TlpA, TetR, LacI, LambdaCI, PhlF, SrpR, QacI, BetR, LmrA, AmeR, LitR, met, and other identifiable by a skilled person, as well as homologues of known repression factors, that function in both prokaryotic and eukaryotic systems. Examples of transcription activation factors include AraC, LasR, LuxR, IpgC, MxiE, Gal4, GCN4, GR, SPl, CREB, etc as well as homologues of known activation factors, that function in both prokarayotic and eukarayotic systems.

"Temperature sensitive transcription factors" "thermal transcriptional bioswitches" or "transcriptional bioswitches" in the sense of the disclosure herein also indicated as "transcriptional bioswitches" are transcription factors that have a DNA-bound state or conformation in which the transcription factor is specifically bound to a corresponding DNA regulatory sequence through a DNA binding domain, and a DNA unbound state or conformation in which the transcription factor is not bound to a corresponding DNA regulatory sequence.

The term "corresponding" as used herein in connection with molecules or residues within a molecule, indicates the ability of the referenced items to react to one another. Thus a DNA regulatory sequence and a DNA binding domain that can react to one another are indicated as "corresponding" Similarly, amino acid residues within a protein or in different protein and that can react with one another can be referred to as corresponding amino acid residues. Also structural motifs within a same or in different molecules that can react and in particular bind one to another can also be referred as "corresponding".

In a temperature sensing transcription factor, the factor can convert from a DNA-bound state to a DNA-unbound state with reference to corresponding DNA regulatory sequence at a bioswitch temperature Tbs.

In particular, temperature sensitive factors in the sense of the disclosure comprise transcriptional bioswitch dimers formed by two monomer proteins. The term "dimer" as used herein indicates a macromolecular complex formed by two polymers and in particular two polypeptides. In a dimer the two protein monomers bind to one another through covalent and/or non-covalent interactions as will be understood by a skilled person. Examples of non-covalent interactions comprise ionic bonds, Van der Waals interactions, polar interactions, salt bridges, coulombic attraction, coulombic repulsion, hydrophobic interaction, and others identifiable by a skilled person. An example of a non-covalently bound protein dimer is the enzyme reverse transcriptase. Examples of covalent interactions comprise any chemical bond that involves the sharing of electron pairs between such as disulfide bridges.

Dimers in the sense of the disclosure can be homodimers and heterodimers. The term "homodimer" means a dimer consisting of two monomers with identical polymer sequence, and in particular two polypeptide or protein monomers with identical amino acid sequence. Examples of protein homodimers include the enzyme cyclooxygenase (COX), the methionine repressor MetJ, TlpA, the lambda repressor cI, and others identifiable by a skilled person. The term "heterodimer" means a dimer of two monomers with non-identical polymer sequence, and in particular two polypeptide or protein monomers with non-identical amino acid sequence. Examples of protein heterodimers include the enzyme reverse transcriptase and others identifiable by a skilled person.

In some embodiments herein described, a protein dimer forming a temperature sensitive transcription factor herein described comprises a DNA binding domain and a temperature-sensing domain.

The term "domain" as related to the protein indicates any continuous part of a protein sequence from single amino acid up to the full protein associated to an identifiable structure within the protein. An "identifiable structure" in the sense of the disclosure indicates a spatial arrangement of the primary structure or portions thereof which can be detected by techniques such as crystallography, hydrophobicity analysis or additional techniques known by a skilled person. In many instances, a protein domain comprises one or more secondary structures of the protein, which together form a tertiary or quaternary structure of a protein.

The "secondary structure" of a protein refers to local sub-structures with a repeating geometry identifiable within crystal structure of the protein, circular dichroism or by additional techniques identifiable by a skilled person. In some instances, a secondary structure of a protein can be identified by the patterns of hydrogen bonds between backbone amino and carboxyl groups. Secondary structures can also be defined based on a regular, repeating, geometry, being constrained to approximate values of the dihedral angles $\psi$ and $\varphi$ of the amino acids in the secondary structure unit on the Ramachandran plot. Two main types of secondary structure are the alpha helix and the beta strand or beta sheets as will be identifiable by a skilled person. Both the alpha helix and the beta sheet represent a way of establishing non-covalent hydrogen bonds between constituents of the peptide backbone, thus forming secondary structural features. Secondary structure formation can be promoted by formation of hydrogen bonds between backbone atoms. Amino acids that can minimize formation of a secondary structure by destabilizing the structure of the hydrogen bonding interactions are referred to as secondary structure breakers. Amino acids that can promote formation of a secondary structure by stabilizing formation of hydrogen bonding interactions are referred to as structure makers.

The term "tertiary structure" refers to the three-dimensional structure of a protein, stabilized by non-covalent interactions among non-adjacent segments of the protein and optionally by one or more additional compounds or ions interacting through covalent or non-covalent interactions with one or more segments of the proteins. Exemplary non-covalent interactions stabilizing the three dimensional structure of the proteins comprise non-specific hydrophobic interactions, burial of hydrophobic residues from water, specific tertiary interactions, such as salt bridges, hydrogen bonds, the tight packing of side chains, chelation and disulfide bonds and additional interactions identifiable by a skilled person. Exemplary covalent interactions among compounds or ions and segments of the protein comprise N-linked glycosylation, cytochrome C haem attachment and additional interaction identifiable by a skilled person.

The term "quaternary structure" when referred to a complex refers to the three dimensional structure of a protein complex, also called a multimer, stabilized by non-transitory interactions between the two or more proteins forming the complex. Accordingly, the quaternary structure can be stabilized by some of the same types of non-covalent and covalent interactions as the tertiary structure as will be understood by a skilled person. Multimers made up of identical subunits are referred to with a prefix of "homo-" (e.g. a homotetramer) and those made up of different subunits are referred to with a prefix of "hetero-", for example, a heterotetramer, such as the two alpha and two beta chains of hemoglobin. "Non-transitory interactions" as used herein indicates interactions between proteins or related segments that are detectable by laboratory techniques such as immunoprecipitation, crosslinking and Forster Resonance Energy Transfer (FRET) measurements, crystallography, Nuclear Magnetic Resonance (NMR) and additional techniques identifiable by a skilled person.

Detection of three-dimensional secondary, tertiary, or quaternary protein structure can be performed using techniques such as x-ray crystallography, NMR spectroscopy, dual polarization interferometry among others known to a skilled person. Using such techniques, the position of structural features comprising alpha-helices, beta strands, turns, beta bridges, bends, loops, coils, coiled coils, and others identifiable by a skilled person within the N-terminal to C-terminal primary sequence of a protein can be detected. In particular, detection of repeated motifs in any one of SEQ ID NO:1 to SEQ ID NO: 456 in a coiled coil domain can be performed using structure prediction servers COILS[4], Paircoil2[5], LOGICOIL[6] and JPred. Structure of polypeptides and proteins can also be obtained from publicly available sources such as Protein Data Bank [12] and others known to a skilled person.

In embodiments herein described, the term "DNA binding domain" refers to a protein domain that contains at least one structural motif configured to recognize and bind double- or single-stranded DNA, wherein the term "motif" refers to a supersecondary structure that appears in multiple protein, and in particular a three-dimensional protein structure of several adjacent elements of a secondary structure that is smaller than a protein domain or a subunit. DNA-binding domains can be part of a larger protein consisting of further protein domains with differing functions including the function of regulating the activity of the DNA-binding domain. The function of DNA binding can be either structural or involve transcription regulation, or both. Many proteins involved in the regulation of gene expression contain DNA-binding domains as will be understood by a skilled person. Such proteins include transcription factors, or transcriptional repressors, among others recognizable by a skilled person.

A DNA-binding domain in the sense of the disclosure can recognize and bind DNA in a DNA sequence-specific or non-sequence-specific manner, which involves molecular complementarity between protein and DNA. The wording "specific" "specifically" or "specificity" as used herein with reference to the binding of a first molecule to second molecule refers to the recognition, contact and formation of a stable complex between the first molecule and the second molecule, together with substantially less to no recognition, contact and formation of a stable complex between each of the first molecule and the second molecule with other molecules that may be present. Exemplary specific bindings are antibody-antigen interaction, cellular receptor-ligand interactions, polynucleotide hybridization, enzyme substrate interactions etc. The term "specific" as used herein with reference to a molecular component of a complex, refers to the unique association of that component to the specific complex which the component is part of. The term "specific" as used herein with reference to a sequence of a polynucleotide refers to the unique association of the sequence with a single polynucleotide which is the complementary sequence. By "stable complex" is meant a complex that is detectable and does not require any arbitrary level of stability, although greater stability is generally preferred In embodiments herein described, a DNA-binding domain of a protein can perform DNA recognition and DNA specific binding for example at the major or minor groove of DNA, or at the sugar-phosphate DNA backbone. DNA-binding domains can recognize specific DNA sequences, such as some DNA-binding domains of transcription factors that activate specific genes, or some DNA-binding domains of transcriptional repressors that repress the transcription of specific genes. Another example is that of enzymes that modify DNA at specific sites, such as restriction enzymes. In particular, the DNA binding domain adopts correctly-oriented alignment of its constituent sub-components to effectively interact with DNA.

The specificity of DNA-binding proteins can be detected using many biochemical and biophysical techniques, such as gel electrophoresis, analytical ultracentrifugation, calorimetry, DNA mutation, protein structure mutation or modification, nuclear magnetic resonance, x-ray crystallography, surface plasmon resonance, electron paramagnetic resonance, cross-linking and microscale thermophoresis (MST), among others recognizable by a skilled person.

In some embodiments herein described where the temperature sensitive transcription factor is a dimer, DNA binding domains of the temperature sensitive transcription factors can be configured to bind with a DNA regulatory sequence upon dimerization of the protein monomers, and therefore be dimerization dependent. The term "dimerization" refers to the process of forming a dimer of two monomers, for example two protein monomers. In particular, dimerization dependent DNA binding domains are configured so that dimerization of the monomer components strengthens the interactions of the domain with a corresponding DNA regulatory sequence, rendering the formation or dissociation of the dimers an intrinsic part of the regulatory mechanisms. Examples of dimerization-dependent DNA binding domains include helix-turn-helix DNA-binding domains or proteins such as tryptophan repressor, lambda Cro, lambda repressor fragment, catabolite gene activator protein (CAP) fragment. In particular, dimerization dependent DNA binding domains can bind to DNA sequences that are composed of two very similar "half-sites," typically also arranged symmetrically. This arrangement allows each protein monomer of the to make a nearly identical set of contacts and enormously increases the binding affinity.

In some embodiments, dimerization dependent DNA binding domains are selected from helix-loop-helix, helix-turn-helix, zinc finger, leucine zipper, winged helix, winged helix turn helix, helix loop helix, HMG-box, Wor3 domain, OB-fold domain, immunoglobulin fold, B3 domain, TAL effector DNA-binding domain, and others recognizable by a skilled person.

In some embodiments, the dimerization-dependent DNA-binding domains herein described comprise a plurality of helical peptide segments each having a primary structure configured to form an alpha helix secondary structure. The term "alpha helix" or "α-helix" indicates a right-hand-coiled or spiral conformation (helix) of a polypeptide in which every backbone N—H group donates a hydrogen bond to the backbone C=O group of the amino acid four residues earlier facilitating hydrogen bonding. The alpha helix is a common secondary structure of proteins and is also sometimes called a classic Pauling-Corey-Branson alpha helix or $3.6_{13}$-helix, the latter indication denoting the number of residues per helical turn, and 13 atoms being involved in the ring formed by the hydrogen bond.

Exemplary dimerization dependent DNA binding domains comprising a plurality of helical peptide segments comprise Helix-turn-helix and basic helix-loop-helix, zinc finger, basic leucine zipper, winged helix-turn-helix, HMG box, Wor3, O-B fold, immunoglobulin domain, B3 DNA binding domain and Tal effector "Helix-turn-helix" indicates a motif composed of two α helices joined by a short strand of amino acids. In particular, the two α helices, the first one occupying the N-terminal end of the motif, and the second one at the C-terminus, perform recognition and binding to DNA of helix-turn-helix proteins. In most cases, such as in the Cro repressor, the second helix contributes most to DNA recognition, and hence it is often called the "recognition helix". It binds to the major groove of DNA through a series of hydrogen bonds and various Van der Waals interactions with exposed bases. The first a helix stabilizes the interaction between protein and DNA, but typically does not play a particularly strong role in its recognition. The recognition helix and its preceding helix always have the same relative orientation. Helix-turn-helix motifs can be classified based on their structure and the spatial arrangement of their helices, for example di-helical, tri-helical, tetra-helical, or winged helix-turn-helix, among others identifiable by a skilled person. For example, helix-turn-helix motif are found in transcription regulatory proteins from bacteriophage lambda and *Escherichia coli*: Cro, CAP, and λ repressor, which share a common 20-25 amino acid sequence that facilitates DNA recognition. Other helix-turn-helix-containing proteins are recognizable by a skilled person.

"Basic helix-loop-helix ("bHLH")" indicates a motif formed by two α-helices connected by a loop. In general, transcription factors including bHLH domain are dimeric, each with one helix containing basic amino acid residues that facilitate DNA binding. In general, in a bHLH one helix is smaller, and, due to the flexibility of the loop, allows dimerization by folding and packing against another helix. In a bHLH DNA binding domain the larger helix typically contains the DNA-binding regions. bHLH proteins typically bind to a consensus sequence called an E-box, CANNTG.[6] The canonical E-box is CACGTG (palindromic), however some basic helix-loop-helix transcription factors, notably those of the bHLH-PAS family, bind to related non-palindromic sequences, which are similar to the E-box. Examples of transcription factors containing a bHLH include AhR, Beta2/NeuroD1, BMAL-1-CLOCK, C-Myc, N-Myc, MyoD, Myf5, Pho4, HIF, ICE1, NPAS1, NPAS3, MOP5, Scl, also known as Tal1, proneural bHLH genes like p-CaM-KII, and pSer(336)NeuroD, Scleraxis, Neurogenins, MAX, OLIG1, OLIG2, and TCF4 (Transcription Factor 4), among other identifiable by a skilled person The term "zinc finger" indicates a motif that is characterized by the coordination of one or more zinc ions in order to stabilize the fold. Proteins that contain zinc fingers (zinc finger proteins) are classified into several different structural families. There are a number of types of zinc fingers, each with a unique three-dimensional architecture. A particular zinc finger protein's class is determined by this three-dimensional structure, but it can also be recognized based on the primary structure of the protein or the identity of the ligands coordinating the zinc ion. In general a zinc finger can comprise between 23 and 28 amino acids long and is stabilized by coordinating zinc ions with regularly spaced zinc-coordinating residues (either histidines or cysteines). The most common class of zinc finger (Cys2His2) coordinates a single zinc ion and consists of a recognition helix and a 2-strand beta-sheet. Other classes of zinc finger domain are identifiable by a skilled person. In transcription factors these domains are often found in arrays (usually separated by short linker sequences) and adjacent fingers are spaced at 3 basepair intervals when bound to DNA as will be understood by a skilled person.

The term "basic leucine zipper (bZIP)" indicates a motif that contains an alpha helix with a leucine at every 7th amino acid. If two such helices find one another, the leucines can interact as the teeth in a zipper, allowing dimerization of two proteins. When binding to the DNA, basic amino acid residues bind to the sugar-phosphate backbone while the helices sit in the major grooves.

The term "winged helix (WH)" indicates a motif comprises four helices and a two-strand beta-sheet and is typically about 110 amino acids. Winged helix motifs can be found in transcription factors e.g. the transcription factors classified into 19 families called FoxA-FoxS, as will be understood by a skilled person.

The term "winged helix-turn-helix (wHTH)" indicates a motif formed by a winged helix-turn-helix DNA-binding motif, where the "wings", or loops, are small beta-sheets. Typically a wHTH is a motif 85-90 amino acids long formed by a 3-helical bundle (H1, H2, H3) and three beta-sheets (S1, S2, S3) and two wings (W1, W2), arranged in the order H1S1-H2-H3-S2-W1-S3-W2. In wHTH, The DNA-recognition helix makes sequence-specific DNA contacts with the major groove of DNA, while the wings make different DNA contacts, often with the minor groove or the backbone of DNA. Several winged-helix proteins display an exposed patch of hydrophobic residues thought to mediate protein-protein interactions.

The term "HMG-box" indicates a motif formed by three alpha helices separated by loops. HMG-box can be found in high mobility group proteins which are involved in a variety of DNA-dependent processes such as replication and transcription. HMG-box motifs also alter the flexibility of the DNA by inducing bends as will be understood by a skilled person.

The term "Wor3" indicates a motif named after the White-Opaque Regulator 3 (Wor3) in *Candida albicans* which is described in Lohse et al 2013 [13] which is capable of DNA specific binding.

The term "OB-fold indicates a small structural motif originally named for its oligonucleotide/oligosaccharide binding properties described in Flynn et al 2010 [14]. OB-fold can range between 70 and 150 amino acids in length and bind single-stranded DNA, and therefore can be included in DNA binding domain in single-stranded binding proteins. OB-fold proteins have been identified as critical for DNA replication, DNA recombination, DNA repair, transcription, translation, cold shock response, and telomere maintenance.

The term "immunoglobulin" refers to a motif consisting of a beta-sheet structure with large connecting loops, which serve to recognize either DNA major grooves or antigens. Usually found in immunoglobulin proteins, immunoglobulin motifs are also present in Stat proteins of the cytokine pathway as will be understood by a skilled person.

The term "B3" indicates a motif including seven beta sheets and two alpha helices, which form a DNA-binding pseudobarrel protein fold. B3 motif typically consists of 100-120 residues and is naturally found exclusively in transcription factors from higher plants and restriction endonucleases EcoRII and BfiI and The term "TAL effectors" indicates a motif containing between 1.5 and 33.5 repeats that are usually 34 residues in length (the C-terminal repeat is generally shorter and referred to as a "half repeat"). A typical repeat sequence is LTPEQVVAIASHDGGKQALETVQRLLPVLCQAHG, (SEQ ID NO: 458) but the residues at the 12th and 13th positions are hypervariable (these two amino acids are also known as the repeat variable diresidue or RVD). Typically TAL effector can comprise a central region of tandem 33-35 residue repeats and each repeat region encodes a single DNA base in the TAL effector's binding site. Within the repeat residue 13 directly contacts the DNA base, determining sequence specificity, while other positions make contacts with the DNA backbone, stabilizing the DNA-binding interaction. Each repeat within the array typically takes the form of paired alpha-helices, while the whole repeat array forms a right-handed superhelix, wrapping around the DNA-double helix. Tal effectors are naturally found in bacterial plant pathogens of the genus *Xanthomonas* among others as will be understood by a skilled person.

In some embodiments, of the transcriptional bioswitch dimers herein described, in each monomer protein the C-terminus of the dimerization dependent DNA binding domain is covalently attached to the N-terminus of the temperature sensitive domain.

The term "attach" or "attached" as used herein, refers to connecting or uniting by a bond, link, force or tie in order to keep two or more components together, which encompasses either direct or indirect attachment where, for example, a first molecule is directly bound to a second molecule or material, or one or more intermediate molecules are disposed between the first molecule and the second molecule or material. In particular in some embodiments, the dimerization dependent DNA binding domain and the temperature sensitive domain can be directly fused to each other, or fused to an interceding linker. The linker can be short (1-5 residues), intermediate (5-10), or long (<10) and can be rigid or flexible Additional linkers are identifiable by a skilled person upon reading of the present disclosure [15]

The term "temperature-sensing domain" refers to a protein or a portion thereof having a sequence configured to provide structural lability in response to temperature changes.

In some embodiments, the temperature sensitive transcription factor is a coiled coil temperature interaction domain, and the temperature-sensing domain is a coiled coil temperature sensing domain comprising temperature sensing supercoiled motif of alpha-helical secondary structures. In particular, the term "coiled coil" indicates a structural motif in a protein in which two to seven alpha-helices are coiled together like the strands of a rope and interact with coiled coil structural motifs in one or more other proteins. Dimers and trimers are the most common types. Coiled coils usually contain a repeated pattern, "hxxhcxc", of hydrophobic (h)- and charged or polar (c) amino-acid residues, referred to as a heptad repeat. The positions in the heptad repeat can be labeled "abcdefg", according to a register where "a" and "d" are generally hydrophobic positions, often being occupied by isoleucine, leucine, or valine.

The term "register" as used herein in relation to a heptad repeat indicates the sequence of the positions a, b, c, d, e, f, g within the heptad repeat in an alpha-helical coiled coil. In particular a register indicates a series of consecutive positions among the possible consecutive a, b, c, d, e, f and g positions starting at any one of positions a, b, c, d, e, f, or g and can be interrupted by variation of the sequence such as deletion or insertions. A heptad coil register can be assigned based on consensus between previous literature [3] and structure prediction servers including COILS[4], Paircoil2 [5], LOGICOIL[6], and Jpred. Folding a sequence with this repeating pattern into an alpha-helical secondary structure causes the generally hydrophobic "a" and "d" residues to be presented as a stripe that coils around the helix, forming an amphipathic structure as will be understood by a skilled person.

In a coiled coil temperature sensing domain, alpha helices of the coiled coil motif form a tertiary structure in a water-filled environment such as the cytoplasm, and in particular the hydrophobic strands are wrapped against each other and are sandwiched between the hydrophilic amino acids. The alpha-helices can be parallel or anti-parallel, and can adopt either a left-handed or right-handed coiled coil. Coiled coils can be depicted using a 'helical wheel' diagram, in which the coiled coils are viewed down the axis of the alpha-helices from N-terminus to C-terminus such as the exemplary structure schematically illustrated in FIG. 16 with reference to the coiled coil domain of TlpA, which shows a series of helical wheel representations of the homodimeric coiled-coil, with each monomer coil made up of heptad repeats.

In the coiled coil transcriptional bioswitch dimers herein described, the temperature sensitive domain of each monomer protein has a temperature sensitive amino acid amino acid sequence having a length from 14 to 3200 amino acid residues, and a sequence

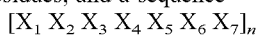

wherein $X_1$ is a hydrophobic amino acid, $X_2$ is a polar or charged amino acid, $X_3$ is a polar or charged amino acid, $X_4$ is a hydrophobic amino acid, $X_5$ is a polar or charged amino acid, $X_6$ is a polar or charged amino acid, and $X_7$ is a polar or charged amino acid and n can be any integer between 2 and 457 (SEQ ID NO: 1 to SEQ ID NO: 456).

The term "polar" as used herein means a molecule, and in particular an amino acid, having a side chain that includes a functional group that have a dipole moment greater than C—H bond. Exemplary polar functional groups include carboxylic acid, ester, amide, nitrile, aldehyde, ketone, hydroxyl group, amino group, and mercapto group.

Exemplary polar amino acids include serine, threonine, asparagine, glutamine, histidine and tyrosine. The nature of side chain of an amino acid residue in a protein or peptide affects the interaction with water in an aqueous environment such as those found in cells.

Hydrophobicity refers to the property of thermodynamically unfavorable interaction with water. In contrast, hydrophilicity refers to the property of thermodynamically favorable interaction with water.

Thus, hydrophobic effect represents the tendency of water to exclude non-polar molecules. The effect originates from the disruption of hydrogen bonds between water molecules. Hydrophobic molecules tend to be nonpolar and, thus, prefer other neutral molecules and nonpolar solvents. Because water molecules are polar, hydrophobic molecules do not dissolve well among them. Hydrophobic molecules in water often cluster together.

There are different hydrophobicity scales (or alternatively, hydropathy indices) of amino acid residues, based on measurement of the level of disruption of hydrogen bonds between water molecules, such as that of Kyte and Doolittle [9] as shown in FIG. 24.

Exemplary hydrophobic amino acids include alanine, valine, leucine, isoleucine, proline, phenylalanine, tryptophan, cysteine and methionine.

Hydrophobicity scales or hydropathy indices are values that can be used to define relative hydrophobicity or conversely relative polarity (hydrophilicity) of amino acid residues, wherein, the more positive the value, the more hydrophobic the amino acid, and conversely the more negative the value, the more polar the amino acid.

Techniques of measuring amino acid hydrophobicity or polarity comprise wet lab methods such as partitioning between two immiscible phases or reverse phase liquid chromatographic methods, or computer-based methods such as calculation of solvent accessible surface area.

Generally, non-polar, hydrophobic amino acids can be considered to have a hydropathy index above zero, with the most hydrophobic, nonpolar amino acids having a Kyte and Doolittle (1982) hydropathy index value above 2, while polar, hydrophilic amino acids have a Kyte and Doolittle (1982) hydropathy index value below zero, with the most polar amino acids having a value below –2. For example, the polar amino acid arginine has a hydropathy index of –4.5, whereas the hydrophobic amino acid leucine has a hydropathy index of 3.8, and the amino acid isoleucine has a hydropathy index of 4.5, thus isoleucine can be considered more hydrophobic than leucine.

Thus, for example, replacement of a hydrophobic amino acid with a hydrophilic amino acid in a polypeptide or protein can change the structure of a polypeptide or protein, or protein-protein interactions, and related functional characteristics of the polypeptide or protein.

The term "charged" as used herein means a molecule, and in particular an amino acid that has an ionically charged side chain, in particular at physiological pH of an intracellular cellular environment, as understood by a skilled person. The α-carboxylic acid group of amino acids is a weak acid, meaning that it releases a proton at moderate pH values. In other words, carboxylic acid groups (—CO2H) can be deprotonated to become negative carboxylates (—CO2-). The negatively charged carboxylate ion predominates at pH values greater than the pKa of the carboxylic acid group.

In a complementary fashion, the α-amine of amino acids is a weak base, meaning that it accepts a proton at moderate pH values. In other words, α-amino groups (NH2-) can be protonated to become positive α-ammonium groups (+NH3-). The positively charged α-ammonium group predominates at pH values less than the pKa of the α-ammonium group.

Among the twenty common natural amino acids, five have a side chain which can be charged. At pH=7.4, two are negatively charged: aspartic acid (Asp, D) and glutamic acid (Glu, E) (acidic side chains), and three are positive charged: lysine (Lys, K), arginine (Arg, R) and histidine (His, H) (basic side chains).

Among the twenty common natural amino acids, five have a side chain which can be charged. At pH=7.4, two are negatively charged: aspartic acid (Asp, D) and glutamic acid (Glu, E) (acidic side chains), and three are positive charged: lysine (Lys, K), arginine (Arg, R) and histidine (His, H) (basic side chains).

Hydrophilic amino acids are amino acid that are considered to be soluble in water and have polar side chains, e.g. comprising —COOH, —OH, —NH$_3$, groups and other groups identifiable by a skilled person. Exemplary hydrophilic amino acid comprise polar or charged amino acid (e.g. polar naturally occurring amino acid serine (Ser), threonine (Thr), asparagine (Asn), glutamine (Gln), and tyrosine (Tyr); and charged naturally occurring amino acid such as lysine (Lys) (+), arginine (Arg) (+), aspartate (Asp) (–) and glutamate (Glu) (–). Hydrophobic amino acids are amino acids that have aliphatic or saturated hydrocarbon side chains (e.g. natural occurring glycine (Gly), alanine (Ala), valine (Val), leucine (Leu), isoleucine (Ile), proline (Pro), phenylalanine (Phe), methionine (Met), and tryptophan (Trp). Polar amino acid can also be involved in hydrogen bond.

In some embodiments, the temperature sensitive amino acid amino acid sequence can have a length of 100 to 500 amino acid residues and n=any integer between 12 and 71, or 250 to 350 amino acid residues, and n=any integer between 32 and 50.

In the coiled coil transcriptional bioswitch dimers, the coiled coil temperature sensing amino acid sequence of each monomer protein can comprise one or more insertions, deletions or replacement. The term "insertion" as used herein means an introduction of one or more amino acids between any two structural features or an introduction of one or more amino acids within one or more structural features in an amino acid sequence. The term "deletion" as used herein means removal of one or more amino acids comprising one or more structural features in an amino acid sequence. The term "replacement" as used herein means substitution of one or more amino acids comprising one or more structural features in an amino acid sequence.

In embodiments, herein described the coiled coil temperature sensing domain of SEQ ID NO: 1 to 456 can include one or more insertions, deletions and/or replacements within a percent variation from 0% to 20% along the total length of the sequences SEQ ID NO: 1 to SEQ ID NO: 456.

The term "percent variation" or "percentage variation" as used herein means the difference between two amino acid residue sequences, expressed as a percentage, wherein the difference between two amino acid sequences is measured by a process that comprises the steps of aligning the two amino acid sequences, then detecting one or more differences between the aligned sequences, and calculating the total number of differences divided by the total number of aligned amino acids in each amino acid sequence, including gaps with the result expressed as a percentage. The term "alignment" as used herein means aligning the positions of structural features of statistically significant structural similarity between two amino acid sequences, where "statistically significant structural similarity" means greater than 95% probability that two structural features are structurally homologous, for example, alpha-helix. The term "difference" indicates mismatches in the position of structural features in the position of structural features in the two amino acid sequences, whereby each amino acid that comprises part of a mismatched structural feature is counted as one difference between the two aligned amino acid sequences. Mismatches between aligned sequences can comprise an insertion, a deletion, and/or a replacement of one or more structural features in one amino acid sequence compared to the other aligned amino acid sequence as would be understood by a skilled person. Several publicly available online servers can be used to detect protein structure alignment and calculate percent variation, such as FATCAT [16], SuperPose [17], iPBA [18], MAPSCI [19], and others known to a person skilled in the art.

In the coiled coil temperature sensing domain, each monomer protein of the domain has a resulting temperature sensing amino acid sequence possibly variated in which the amino acid residues $X_1$ to $X_7$ are arranged in the temperature sensing amino acid sequence to form at least two complete consecutive uninterrupted heptad repeats without modification of any of positions a, b, c, d, e, f, or g, and possibly additional interrupted or uninterrupted heptad repeats each having a register in which up to 5 consecutive amino acid residues are optionally missing in view of possible insertions, deletions and/or replacements on SEQ ID NO: 1 to SEQ ID NO: 456 within the 0% to 20% variation range to have a total of 2 to 457 consecutive uninterrupted heptad repeats in the temperature sensing amino acid sequence.

Accordingly, in a temperature sensitive amino acid sequence amino acid residues $X_1$ to $X_7$ can be arranged in heptad repeats each with a register that begins with either a, b, c, d, e, f or g. Accordingly, an uninterrupted series of heptad repeats without modification of any one of the a with amino acids annotated with 'H' on the lower row representing an amino acid that forms part of a predicted heptad repeat of a coiled-coil domain. The secondary structure prediction of TlpA was performed using the software JPred. This software predicts that the DNA binding domain of TlpA consists of three alpha helices separated by short linkers.

Structure prediction servers such as COILS[4], Paircoil2 [5] and LOGICOIL[6] and Jpred among other as will be understood by a skilled person can be further used for analysis of coiled coil domains. Graphical depictions of coiled coils can be produced using software such as Draw-Coil 1.0[7]. Examples of structural analysis results of TlpA using these programs are shown in FIG. 14, FIG. 15, FIG. 16, and FIG. 17.

Figure 14:
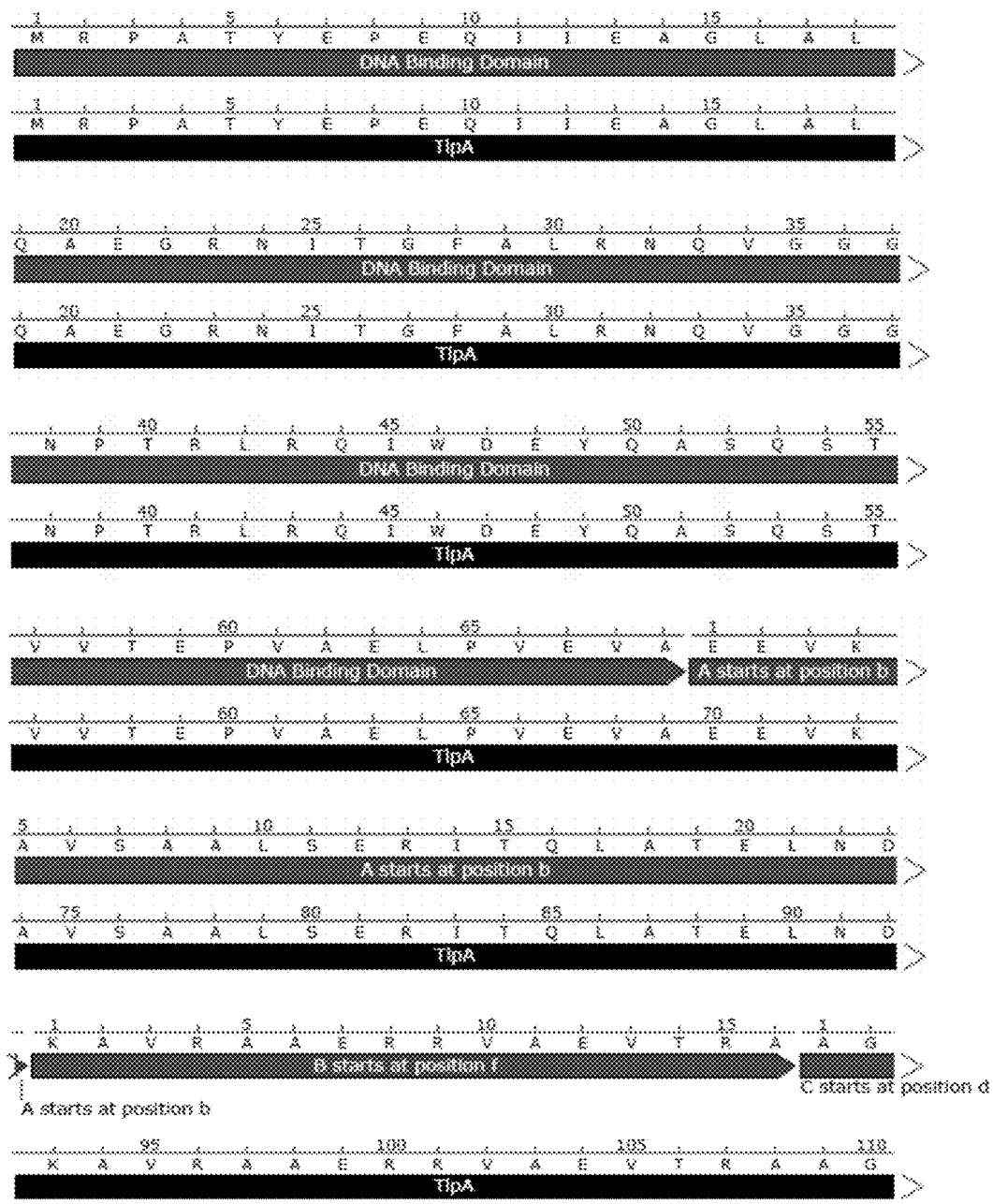
FIG. 14 shows the amino acid sequence of TlpA (SEQ ID NO: 461) divided into heptad repeat portions 'A' through 'M' in the predicted coiled-coil domain, with the coil register of heptads assigned based on consensus between previous literature [3] and the structure prediction servers Paircoil2[5] and LOGICOIL[6]. The register position within the heptad repeat for each predicted heptad repeat portion 'A' through 'M' is indicated; for example "A starts at position b". The predicted DNA binding domain is also indicated (residues 1 to 69). The amino acid position number within each heptad portion of the coiled coil domain and within the DNA binding domain is indicated above each upper row (grey), while the amino acid position number within the whole TlpA protein sequence is indicated above each lower row (black). The symbol "*" indicates the stop codon at the C-terminus of the TlpA protein. An arrowhead symbol '>' at the end of each line indicate the direction of the amino acid sequence.
Figure 14:
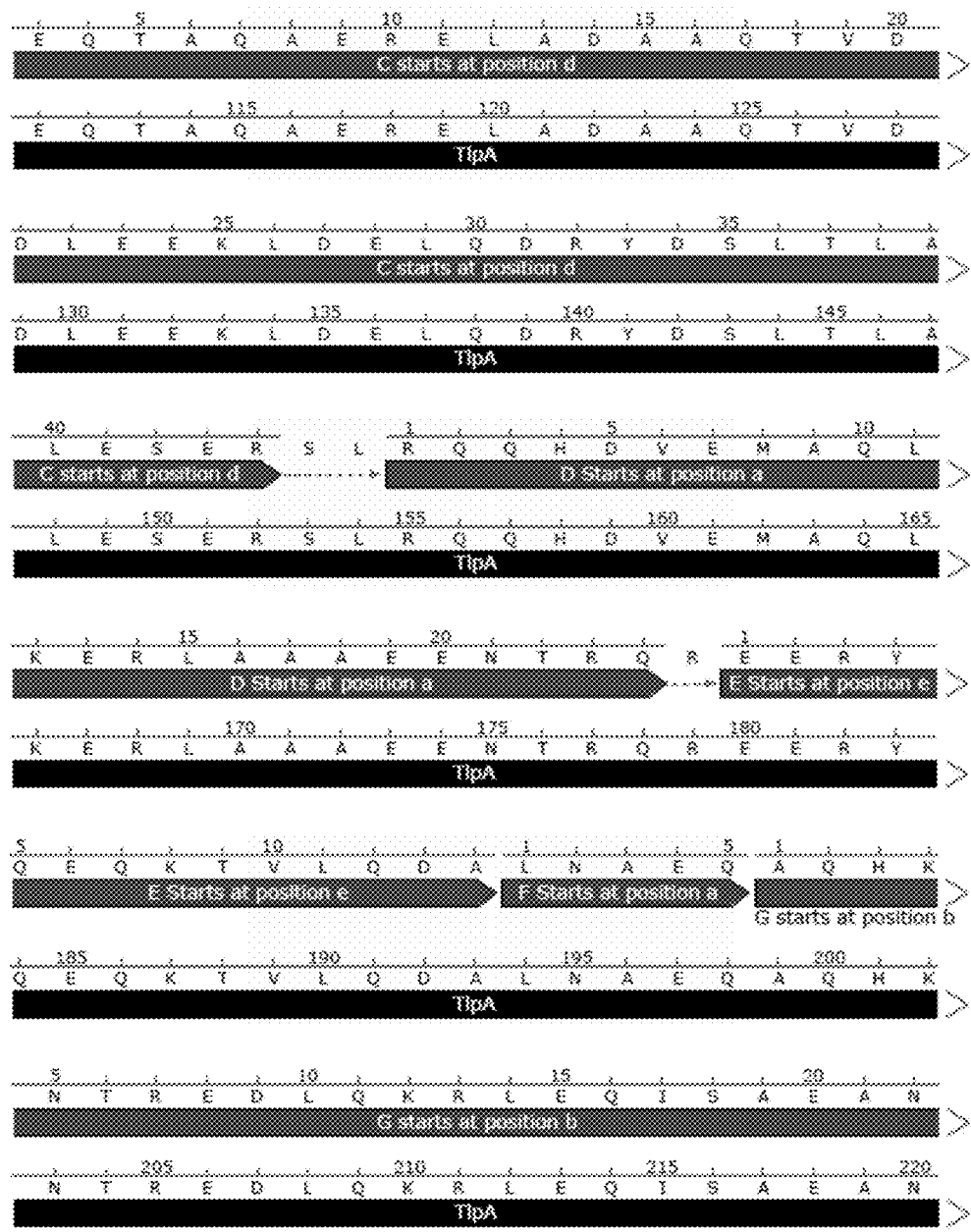
Figure 14:
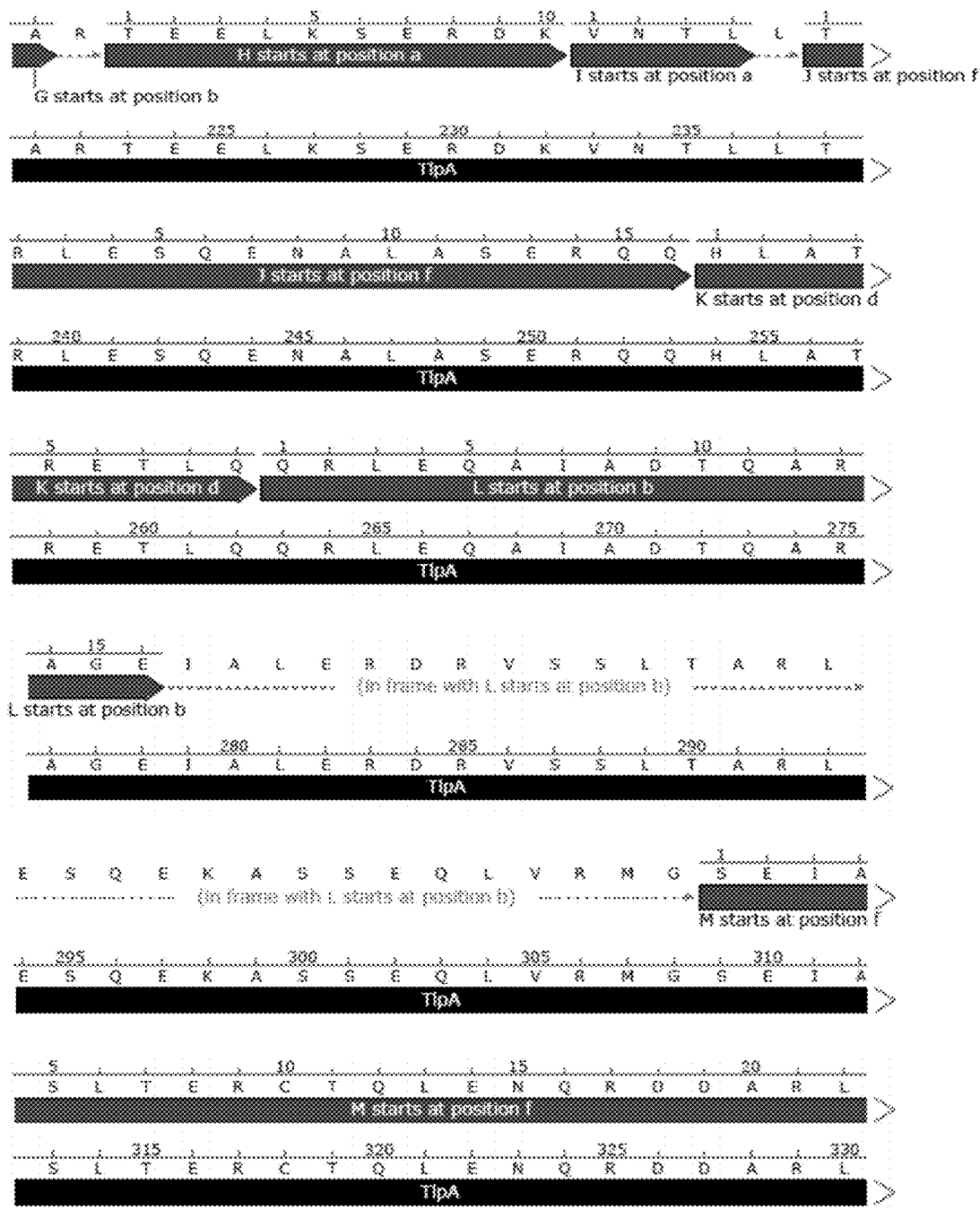
Figure 14:
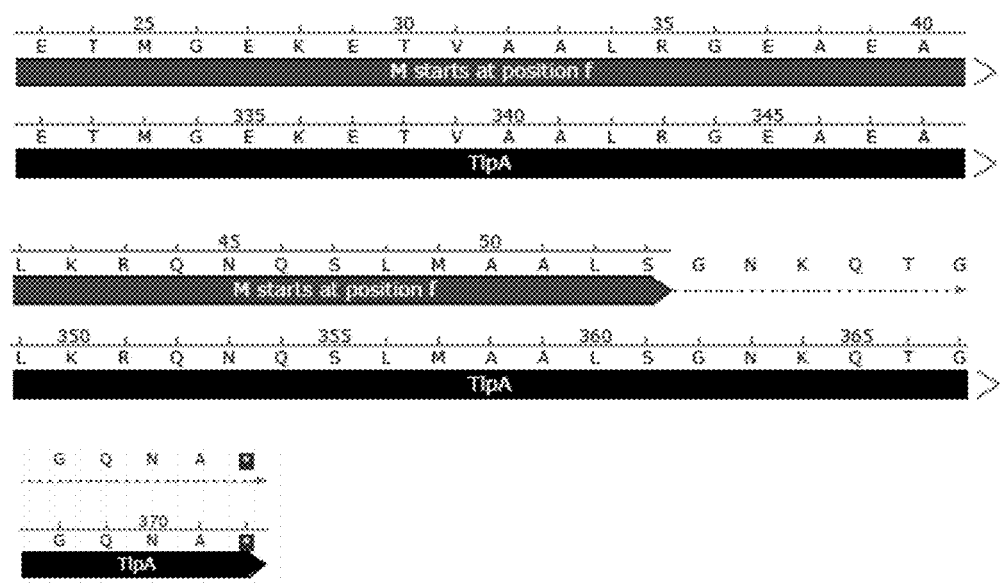

FIGS. 14 and 15 shows the amino acid sequence of TlpA divided into heptad repeat portions 'A' through 'M' in the predicted coiled-coil domain, with the coil register of heptads assigned based on consensus between previous literature [3] and the structure prediction servers Paircoil2[5] and LOGICOIL[6]. In particular, the register position within the heptad repeat for each predicted heptad repeat portion 'A' through 'M' is indicated; for example "A starts at position b" (see FIG. 14). In FIG. 14, the amino acid position number within each heptad portion of the coiled coil domain and within the DNA binding domain is indicated above each upper row, while the amino acid position number within the whole TlpA protein sequence is indicated above each lower row. The symbol "*" indicates the stop codon at the C-terminus of the TlpA protein. An arrowhead symbol '>' at the end of each line indicate the direction of the amino acid sequence.

FIG. 16 shows 'helical wheel' diagrams of the predicted structure of the TlpA coiled-coil interface as viewed down the long axis of the helix, with two TlpA proteins shown side-by-side, in a predicted dimer configuration of the transcriptionally repressive state. Each helical wheel diagram (FIG. 16(a)-(m)) shows a portion of the predicted coiled-coil domain, divided into uninterrupted amino acid sequences that are predicted to fit into the same heptad register, according to the sequences listed in FIG. 15, as follows: FIG. 16(a) corresponds to FIG. 15 Heptad repeat 'A'; FIG. 16(b) corresponds to FIG. 15 Heptad repeat 'B'; FIG. 16(c) corresponds to FIG. 15 Heptad repeat 'C'; FIG. 16(d) corresponds to FIG. 15 Heptad repeat 'D'; FIG. 16(e) corresponds to FIG. 15 Heptad repeat 'E'; FIG. 16(f) corresponds to FIG. 15 Heptad repeat 'F'; FIG. 16(g) corresponds to FIG. 15 Heptad repeat 'G'; FIG. 16(h) corresponds to FIG. 15 Heptad repeat 'H'; FIG. 16(i) corresponds to FIG. 15 Heptad repeat 'I'; FIG. 16(j) corresponds to FIG. 15 Heptad repeat 'J'; FIG. 16(k) corresponds to FIG. 15 Heptad repeat 'K'; FIG. 16(l) corresponds to FIG. 15 Heptad repeat 'L'; FIG. 16(m) corresponds to FIG. 15 Heptad repeat 'M'. The predicted alpha-helical heptad repeat (labeled a-b-c-d-e-f-g) is shown, connected by progressively thinner straight lines shown in an N-terminal to C-terminal direction. A dashed line is shown between the last residue of a heptad and the first residue of a next heptad in a portion of the heptad repeat. Single-letter amino acid symbols shown circled at each position in a heptad. The sequence of amino acids in an N-terminal to C-terminal direction are shown at each position of a heptad, with the first heptad in the portion of the heptad repeat shown on the line of each large circle representing an alpha-helix, and the amino acids of consecutive heptads are shown further out from the large circle Blue dashed lines represent predicted energetically favorable ionic interactions; red dashes indicate predicted repulsive ionic interactions. The coil register was assigned based on the COILS server in the www.ch.embnet.org/cgi-bin/COILS_form_parser webpage. The images were produced using DrawCoil 1.0[7].

In some embodiments, the temperature sensitive transcription factor is a globular temperature sensitive factor, and the temperature-sensing domains contain two globular monomers forming a dimer by interactions between the C-terminal domains (CTDs) of the two monomers. The term "globular protein" indicates spherical, globe-like proteins induced by the proteins' tertiary structure, comprising a core interface and an exterior solvent-exposed face. The term "interface" as used herein in connection with globular temperature sensitive transcription factors, and in general with homodimers of the disclosure, indicates a portion of a monomer protein comprising amino acids involved in the cooperative binding of the monomer protein with the other monomer protein forming the homodimer. The term "core interface" as used herein refers to amino acid residues centrally located within a dimerization domain at the interface of dimerized proteins The term "exterior solvent exposed face" indicates a portion of the monomer protein comprising amino acid outside the interface and interacting with the solvent. Amino acid residues typically found at the interface are hydrophobic, but can also comprise polar or charged amino acids. Amino acids comprising the exterior solvent exposed face are usually polar or charged, but can be hydrophobic. The non-polar (hydrophobic) amino acids are generally bounded towards the molecule's interior whereas polar, hydrophilic amino acids are generally bound outwards, allowing dipole-dipole interaction with the solvent, thus contributing to the molecule's solubility. Globular protein structure can be determined by using techniques including ultracentrifugation, dynamic light scattering, and other techniques known to those skilled in the art.

In globular temperature sensitive transcription factors herein described the temperature-sensing domain comprises a homodimeric globular structure, in which each monomer comprises a C-terminal domain ("CTD") of about 105 residues in length The CTDs mediates the dimerization of the temperature-sensing domain in the thermal transcription bioswitches, which cooperatively leads to the dimerization of the DNA-binding domain connected to the temperature-sensing domain and subsequently the binding of the DNA-binding domain to the recognition sequence of the DNA.

In the globular temperature sensitive transcription factor, the temperature sensitive domain of each monomer protein has a length of 105 amino acids. and comprises an A bend, a B bend, a C bend, a D bend, an E bend, an F bend, a G bend, an H bend, an I bend, a J bend, a K bend, an L bend, an M bend, a βA strand, a βB strand, a βC strand, a βD strand, a βE strand, a βF strand, an A turn, a B turn, a C turn, and a βA bridge linked one to another by loop regions. The globular temperature sensing domain can have has a sequence (SEQ ID NO: 457)
$X_1-X_2-X_3-X_4-X_5-X_6-X_7-X_8-X_9-X_{10}-X_{11}-X_{12}-X_{13}-X_{14}-X_{15}-X_{16}-$ $X_{17}-X_{18}-X_{19}-X_{20}-X_{21}-X_{22}-X_{23}-X_{24}-X_{25}-X_{26}-X_{27}-X_{28}-X_{29}-X_{30}-X_{31}-$ $X_{32}-X_{33}-X_{34}-X_{35}-X_{36}-X_{37}-X_{38}-X_{39}-X_{40}-X_{41}-X_{42}-X_{43}-X_{44}-X_{45}-X_{46}-$ $X_{47}-X_{48}-X_{49}-X_{50}-X_{51}-X_{52}-X_{53}-X_{54}-X_{55}-X_{56}-X_{57}-X_{58}-X_{59}-X_{60}-X_{61}-$ $X_{62}-X_{63}-X_{64}-X_{65}-X_{66}-X_{67}-X_{68}-X_{69}-X_{70}-X_{71}-X_{72}-X_{73}-X_{74}-X_{75}-X_{76}-$ -continued $X_{77}-X_{78}-X_{79}-X_{80}-X_{81}-X_{82}-X_{83}-X_{84}-X_{85}-X_{86}-X_{87}-X_{88}-X_{89}-X_{90}-X_{91}-$ $X_{92}-X_{93}-X_{94}-X_{95}-X_{96}-X_{97}-X_{98}-X_{99}-X_{100}-X_{101}-X_{102}-X_{103}-X_{104}-X_{105}$ wherein $X_1$ can be a polar residue defining an N-terminal residue;
$X_2$ can be a polar residue forming the A bend;
$X_3$ to $X_5$ can be polar or charged residues forming a loop;
$X_6$ to $X_8$ can be polar amino acids forming the B bend;
$X_9$ can be polar amino acid forming a loop;
$X_{10}$ to $X_{13}$ can be any amino acids forming the βA strand;
$X_{14}$ to $X_{15}$ can be any amino acids forming a loop;
$X_{16}$ to $X_{19}$ can be polar residues forming the C bend;
$X_{20}$ to $X_{22}$ can be polar or non-polar amino acids forming a loop;
$X_{23}$ to $X_{24}$ can be polar amino acid residues forming the D bend;
$X_{25}$ can be a non-polar amino acid forming a loop;
$X_{26}$ to $X_{27}$ can be polar or ionic amino acids forming the E bend;
$X_{28}$ to $X_{30}$ can be polar or non-polar amino acids forming a loop;
$X_{31}$ to $X_{32}$ can be polar, non-polar or ionic amino acids forming the F bend;
$X_{33}$ can be any amino acid forming a loop;
$X_{34}$ to $X_{37}$ can be non-polar amino acids forming the βB strand;
$X_{38}$ to $X_{39}$ can be any amino acids forming a loop;
$X_{40}$ to $X_{41}$ can be any amino acids forming the G bend;
$X_{42}$ to $X_{44}$ can be any amino acids forming a loop;
$X_{45}$ to $X_{46}$ can be any amino acids forming the A turn;
$X_{47}$ can be a non-polar amino acid forming the H bend;
$X_{48}$ to $X_{52}$ can be polar, non-polar, or ionic amino acids forming the βC strand;
$X_{53}$ can be any amino acid forming the I bend;
$X_{54}$ to $X_{56}$ can be any amino acids forming the B turn;
$X_{57}$ to $X_{60}$ can be any amino acids forming a loop;
$X_{61}$ to $X_{64}$ can be any amino acids forming the βD strand;
$X_{65}$ to $X_{66}$ can be any amino acids forming a loop;
$X_{67}$ to $X_{69}$ can be any amino acids forming the J bend;
$X_{70}$ can be any amino acids forming a loop;
$X_{71}$ to $X_{73}$ can be any amino acids forming the βE strand;
$X_{74}$ can be any amino acid forming a loop;
$X_{75}$ to $X_{76}$ can be any amino acids forming the K bend;
$X_{77}$ to $X_{78}$ can be polar amino acids forming the C turn;
$X_{79}$ can be a polar amino acid forming the L bend;
$X_{80}$ to $X_{81}$ can be polar amino acids forming a loop;
$X_{82}$ can be a polar amino acid forming the βA bridge;
$X_{83}$ to $X_{88}$ can be polar amino acids forming a loop;
$X_{89}$ to $X_{96}$ can be polar or ionic amino acid residues forming the βF strand;
$X_{97}$ to $X_{100}$ can be polar or non-polar amino acids forming a loop;
$X_{101}$ to $X_{103}$ can be polar amino acids forming the M bend;
$X_{104}$ to $X_{105}$ can be polar or non-polar amino acids defining a C-terminal segment.

In particular in which the globular temperature sensing domain is a dimer of two monomers, each containing a globular structure having a core interface and exterior solvent exposed face. Each monomer interacts with the corresponding portion of the other monomer through chemical and/or physical interactions at the core interface to form a globular temperature sensitive transcription factor. In those embodiments, cooperative unfolding of the monomers results in a loss of the ability to correctly position the two halves of the DNA binding domain found at the N-termini of each protein monomer. Tuning of the thermal response curve is achieved by modulating the affinity of the two monomers.

In globular sensitive temperature sensing domain the dimerization of each monomer to form the domain in the dimer, involves interactions of secondary structures within the two monomers driving dimerization. In particular, a single-strand alpha-helix or a random coil can interact with a corresponding alpha-helix in another monomer to form a double-strand coiled-coil interaction domain. In a globular structure comprising segments, loops, bends, β-strands, turns, and β-bridges, each structure can interact with the corresponding portion of the other monomer through chemical and/or physical interactions at the core interface to form a dimer as will be understood by a skilled person.

In a globular sensitive temperature sensing domain of SEQ ID NO:457 residues $X_1$, $X_2$, $X_{20}$ to $X_{22}$, $X_{25}$, $X_{28}$ to $X_{30}$, $X_{31}$ to $X_{32}$, $X_{34}$ to $X_{37}$, $X_{47}$, $X_{48}$ to $X_{52}$, $X_{77}$ to $X_{78}$, $X_{79}$, $X_{80}$ to $X_{81}$, $X_{82}$, $X_{83}$ to $X_{88}$, $X_{89}$ to $X_{96}$, $X_{97}$ to $X_{100}$, and $X_{104}$ to $X_{105}$ are located in the globular temperature sensitive domain interface between the two monomer proteins:

In a globular sensitive temperature sensing domain of SEQ ID NO:457 residues $X_3$ to $X_5$, $X_6$ to $X_8$, $X_9$, $X_{16}$ to $X_{17}$, $X_{23}$ to $X_{24}$, $X_{42}$ to $X_{44}$, $X_{45}$ to $X_{46}$, $X_{53}$, $X_{54}$ to $X_{56}$, $X_{57}$ to $X_{60}$, $X_{67}$ to $X_{69}$, $X_{70}$ are solvent exposed amino acids:

In a globular sensitive temperature sensing domain of SEQ ID NO:457 residues X101 to X103 in SEQ ID NO:457 are polar residues coordinated to other polar residues by hydrogen bonding, and have structural characteristics similar to polar residues at the interface between the two monomers In some embodiments, the globular temperature sensing domain can also include a variant of SEQ ID NO: 457 in which any of the amino acid residues of SEQ ID NO: 457 is substituted with a ΔΔG of substitution of a Rosetta modeling software greater than –0.5 Rosetta Energy Unit (REU) or lower than 0.5 Rosetta Energy Unit (R.E.U).

The term "Rosetta Energy Unit" or "R.E.U." as used herein indicates a unit to measure rosetta energy on an arbitrary scale using the Rosetta software package.

In particular, Rosetta software package includes algorithms for computational modeling and analysis of macromolecular structures as well as tools for structure prediction, design and remodeling of proteins and nucleic acids (http://www.rosettacommons.org). In particular, Rosetta Backrub model (see the website http://kortemmelab.ucsf.edu/backrub at the filing date of the present disclosure) implements the Backrub method, derived from observations of alternative conformations in high-resolution protein crystal structures, for flexible backbone protein modeling. Backrub modeling is applied to three related applications using the Rosetta program for structure prediction and design: (i) modeling of structures of point mutations, (ii) generating protein conformational ensembles and designing sequences consistent with these conformations and (iii) predicting tolerated sequences at protein-protein interfaces. Detailed description about the Rosetta software package and RosettaBackrub can be found in related literature such as Lauck F. et al. (2010) [27]. As a person of ordinary skill in the art would understand, the program can be used to automatically generate libraries of sequence variations for protein interfaces that can be further screened experimentally for changes in protein interaction affinity.

In particular, RosettaBackrub can create ensembles of structures for flexible backbone modeling. This method has been derived from observations of alternative conformations in high-resolution crystal structures and involves local backbone rotations about axes between Cα atoms of protein segments. In general, first, a segment of typically 2-12 residues is randomly selected. Then, all atoms of this fragment are rotated as a rigid body by an angle of up to 11-40° around the axis between the two $C_\alpha$ pivot atoms (see the web server online documentation section for details). Backrub moves, interleaved with rearrangements of the surrounding side chains, are sampled by a Monte Carlo algorithm using the Rosetta all-atom force field. Backrub and side chains moves are made 10000 times, with each new conformation being scored with the Rosetta scoring function. The resulting score is used to determine whether the new conformation is accepted or not according to the Metropolis criterion. In order to create an ensemble of size N this algorithm is independently applied N times to the input structure. Side-chain sampling and scoring in sequence design are as described in Kuhlman et al. (2003) [28]

The Protein Interface Sequence Plasticity Prediction model of RosettaBackrub predicts the sequence diversity (also referred to as "plasticity") in protein-protein interfaces. This application models the tolerated sequence space for interface positions in a protein complex [29] such as the interface of SEQ ID NO: 459. First, Backrub is applied to the two interaction partners in a protein-protein complex to create a conformational ensemble. Backbone flexibility is modeled at all positions in each complex partner. Each of the resulting complex structures is then subject to the sequence plasticity protocol. This protocol uses a genetic algorithm to sample amino acid changes at interface positions specified by the user. Modeled residues are scored according to their contributions to the stability of the protein partners as well as to the stability of the protein-protein interface. Interface sequences are recorded and kept if their score is within a threshold from the interface and complex scores of the sequence in the input file, as described in Humphris et. al. The input for the application model is a single PDB structure and the output is the PDB files of the generated ensemble, as well as the sequences and frequencies of amino acids of the designed ensemble.

The rosetta energy function used in the Rosetta software package is a linear sum of individually weighted terms shown below. Detailed description of the rosetta energy function can be found in related literatures such as Renfrew et. al. (2012) [30]. In brief, the rosetta energy function contains a physically-based inter-residue Lennard-Jones term split into repulsive and attractive components ($E_{inter\_rep}$ and $E_{inter\_atr}$), a implicit solvation term implemented as described by Lazarids and Karplus ($E_{solvation}$), knowledge-based reside pair electrostatics term ($E_{pair}$), orientation dependent hydrogen bonding term ($E_{sc/bb}$, $_{hb}$, $E_{bb,bb}$ $_{hb}$ and $E_{sc/sc}$ $_{hb}$), a knowledge-based term that measures the internal energy of an amino acid based on probabilities from rotamer libraries (the rotamer internal energy term, $E_{dunbrack}$), a knowledge-based term that measures Ramachandran backbone torsion preferences of a position (the rama term, $E_{rama}$), and a reference energy term that represents the energy of the unfolded state of a protein ($E_{ref}$).

$$E_{protein} = W_{inter\ rep}E_{inter\ rep} + W_{interate}E_{interate} + W_{solvation}E_{solvation} +$$
$$W_{bb/schb}E_{bb/schb} + W_{bb/bbbb}E_{bb/bbhb} + W_{sc/schb}E_{sc/schb} +$$
$$W_{pair}E_{pair} + W_{dunbrack}E_{dunbrack} + W_{rama}E_{rama} + W_{reference}E_{reference}$$

The rosetta energy obtained from the above equation is on an arbitrary scale, also referred to as Rosetta Energy Unit ("REU"). In general, structures with lower rosetta energies are considered to be more stable than structures with higher energies. The rosetta energy difference between two structures can be defined as $\Delta\Delta G$, which is defined as $E_{protein2} - E_{protein1}$. Protein1 can be a WT while protein2 can be a variant of the WT with a single or multiple amino acid substitutions.

Therefore, the term $\Delta\Delta G$ as used herein indicates the rosetta energy difference between two structures defined as $E_{protein2} - E_{protein1}$. In variants herein described Protein1 can be a WT while protein2 can be a variant of the WT with a single or multiple amino acid substitutions.

In some embodiment, the globular temperature sensing domain, each monomer protein can have a globular temperature sensing amino acid sequence TTKKASD-SAFWLEVEGNSMTAPTGSKPSFPDGMLIL-VDPEQAVEPGDFCIARLGGDEFTFKKLIRD SGQVFLQPLNPQYPMIPCNESCSVVGKVI-ASQWPEETFG (SEQ ID NO: 459), or a variant of SEQ ID NO: 457 in which any of the amino acid residues of SEQ ID NO: 459 is substituted with a $\Delta\Delta G$ of substitution greater than −0.5 Rosetta Energy Unit (REU) or lower than 0.5 Rosetta Energy Unit (R.E.U).

A representative example of a globular sensing domain is a temperature-sensitive variant of the bacteriophage λ repressor cI (mutant cI$^{857}$ containing an A67T mutations, herein referred to as TcI) acting on a tandem pR-pL operator-promoter. TcI repression has been modulated via large changes in temperature (e.g., steps from 30° C. to 42° C.), rather than a sharper switching. The cI repressor of bacteriophage λ is another example of a protein that binds to its operator sites cooperatively. The C-terminal domain of the repressor mediates dimerization as well as a dimer-dimer interaction that results in the cooperative binding of two repressor dimers to adjacent operator sites. Detailed structural information is available for the isolated domains of the cI repressor [31] and intact dimeric cI repressor bound to an operator sequence [8]

Figure 22:
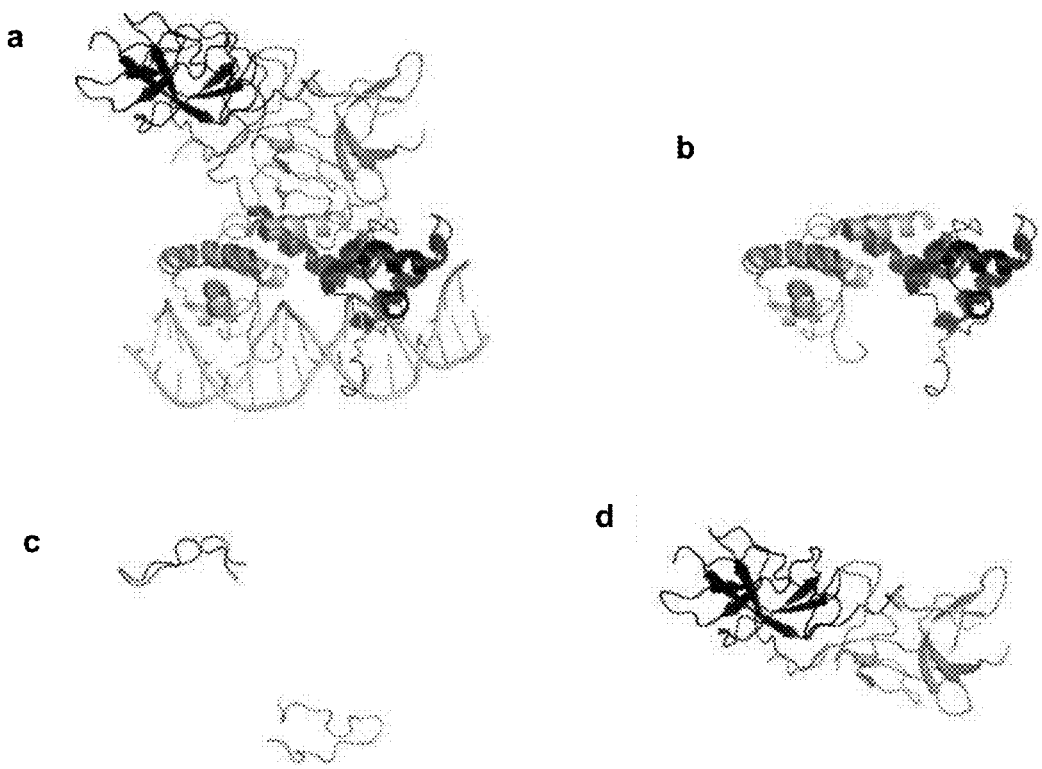
FIG. 22(*a*) shows a crystal structure model image depicting a dimer of TcI. The crystal structure of the wild type lambda repressor (Protein Data Bank (PDB) code 3BDN) was used as the homology model[8]. The DNA binding domain is shown in contact with a double helix DNA structure representing the pr/pL binding site.

The TcI protein is composed of two structurally distinct domains that are tethered by a protease sensitive connector. The N-terminal DNA binding domain (residues 1-92 of FIG. 21) which contains a helix-turn-helix DNA-binding motif, is a compact alpha-helical domain that weakly self-associates to form a dimer. Dimers of the DNA binding domain recognize and bind to the operator sequences using this helix-turn-helix motif. The C-terminal domain (residues 132-236; FIG. 21), otherwise referred to as the "globular dimerization domain" or "globular domain" is a highly twisted beta-sheet structure that is responsible for establishing the essential dimer contacts and for mediating the higher-order dimer-dimer interactions that underlie cooperative binding to the DNA. In addition, the C-terminal domain performs a self-cleavage reaction, which is triggered in bacteriophage lambda when the lysogenic cell suffers DNA damage and depends upon an activated form of the bacterial RecA protein. This self-cleavage reaction inactivates the repressor by separating the N-terminal domain from the C-terminal domain. The connector (residues 93-131; FIG. 21) which contains the cleavage site, consists of a small protease sensitive linker and the cleavage site region. Structurally the cleavage site region is an integral part of the C-terminal domain, forming a pair of antiparallel beta-strands that drapes across its surface. Cleavage occurs at a specific site (between Ala111 and Gly112) within a long loop (residues 106-126) that connects the antiparallel beta strands of the cleavage site region. A depiction of the crystal structure of TcI is shown in FIG. 22. The crystal structure of the wild type lambda repressor (Protein Data Bank (PDB) code 3BDN) was used as the homology model for TcI [8].

In transcriptional bioswitch dimers herein described, two monomer proteins configured to bind to one another to form a dimer in a target environment comprising a DNA polynucleotide having a DNA coding region under control of a DNA regulatory region, the dimer configured to have a DNA-bound state and an DNA-unbound state with respect to specific binding of the dimer to the DNA polynucleotide in the target environment.

The temperature sensing domain of the transcriptional bioswitch dimer controls dimer formation as well as binding and unbinding of the transcription factor from DNA and the related conversion from a DNA bound state to a DNA-unbound state.

In particular, in each temperature sensing domain of transcriptional bioswitch dimers herein described, each monomer proteins are configured to bind to one another with a target environment with a binding constant Kd≤100 nM in the DNA-bound state and ≥10 uM in the DNA-unbound state wherein $$K_d = e^{\left(\frac{\Delta G}{RT}\right)}$$  Eq. (1)

in which R is the gas constant, T is the temperature of the target environment and ΔG is the molar Gibbs free energy.

In each temperature sensing domain of transcriptional bioswitch dimers herein described, each monomer protein is further configured to bind to one another in the target environment with a thermal Hill coefficient above 15 to form the dimer in a temperature dependent manner.

In some embodiments, the two monomer proteins of the temperature sensing domain are further configured to bind to one another in the target environment with a thermal Hill coefficient from 15 to 40 to form the dimer in a temperature dependent manner.

In particular in coiled coil and globular transcriptional bioswitch dimers herein described, the dimerization or de-dimerization of two monomers exhibits a cooperative behavior, also referred to as "cooperativity". Cooperativity occurs in molecular structures containing multiple binding sites. In general, cooperativity describes the changes in conformation or binding energy that occur when a binding site of one of these structures is activated or deactivated effecting the other binding sites in the same molecule. It can also be described as the increasing (positive cooperativity) or decreasing (negative cooperativity) affinity for binding of the other sites affected by the original binding site. Cooperativity can occur in enzymes, receptors, DNA and many molecules that are made of identical or near identical subunits. An example of positive cooperativity can be seen on the binding of oxygen to hemoglobin to form oxyhemoglobin. Another example is the unwinding of DNA in which sections of DNA first unwind followed by the process of unwinding another group of adjacent nucleotides. Similar processes also apply to other types of chain molecules, such as the folding and unfolding of alpha-helices in coiled-coils of the temperature-sensing domain.

In embodiments herein described, the cooperativity of a temperature-sensing domain can be quantified by a single parameter referred to as "Hill coefficient". The Hill coefficient is a measure for the cooperative of the temperature-sensing domain de-dimerization transition. High Hill coefficients go together with sharp de-dimerization transitions while low Hill coefficients indicate a gradual transition from the folded dimer to unfolded two monomer conformation. The Hill coefficient can be mathematically calculated from fitting a circular dichroism (CD) melting curves as follow:

$$f(T) = \frac{aT^b}{T_m^b + T^b}$$  Eq. 2 where $T_m$ is the melting temperature of a temperature-sensing domain, a the amplitude, T the temperature and b the Hill coefficient.

The melting temperature "Tm" of a temperature sensing binding domain is the temperature, at which the temperature sensing binding domain within a temperature sensitive transcription herein described denaturates. The change in size or structure that accompanies the protein denaturation can be identified using DLS techniques, CD techniques and other techniques identifiable by a skilled person. Factors affecting the Tm of a temperature sensing domain comprise the primary sequence of amino acids and environment conditions, e.g. pH and salt concentration, as well as post translational modifications, e.g. glycosylation, and formation of complex with other molecules (proteins or DNA) or other factors that can affect the stability of the protein structure and hence the melting temperature as will be understood by a skilled person.

As a person skilled in the art would understand, CD and other spectroscopic measurements that measure changes in absorption and fluorescence collected as a function of temperature can determine the thermodynamics of protein unfolding and binding interaction. For example, measuring CD as a function of temperature can be used to determine the effects of mutations on protein stability, as well as the binding constants of interacting proteins and protein-ligand complexes.

In some embodiments, a CD melting curve can be recorded using spectroscopic technique for following the de-dimerization and dimerization of temperature-sensing domains as a function of temperature, as will be understood by a person skilled in the art (see Example 6).

In coiled coil temperature sensitive transcription factors herein described, the temperature-sensing domains in the sense of the current disclosure contain a two-stranded α-helical coiled-coil structure that have sharp uncoiling transitions with a Hill coefficient above 15. In some embodiments, the two monomer proteins of the coiled coil temperature sensing domain are further configured to bind to one another in the target environment with a thermal Hill coefficient from 15 to 40 to form the dimer in a temperature dependent manner. For example, the coiled-coil domain of TlpA has a Hill coefficient of from about 15 to 25 (see Example 6).

For example a sharp transition of TlpA protein dimerization between coiled coil domains of each monomer features cooperative binding, as indicated by the Hill coefficient (see Example 6). Identification of proteins having similar cooperative dimer binding can be done using techniques including circular dichroism (CD) spectroscopy and calculating Hill coefficient from fitting a circular dichroism (CD) melting curve, as previously described.

In globular temperature sensitive transcription factors herein described, the two globular monomers forming a dimer by interactions between the C-terminal domains (CTDs) of the two monomers, also have sharp de-dimerization transitions with a Hill coefficient above 15. In some embodiments, the two monomer proteins of the globular temperature sensing domain are further configured to bind to one another in the target environment with a thermal Hill coefficient from 15 to 40 to form the dimer in a temperature dependent manner.

In temperature sensitive transcription factors herein described and in particular in coiled coil and globular temperature sensing domain, the Tm of the temperature sensing domain also controls the temperature of the target environment at which the temperature sensitive transcription factor is converted from the DNA bound state to the DNA unbound state herein also bioswitch temperature or Tbs), determined by the melting temperature Tm of the temperature sensitive binding domain.

In particular in temperature sensitive transcription factors in which the temperature sensing domain is a coiled-coil interaction domain essentially consisting of supercoiled alpha-helical structure, cooperative unfolding of the coil results in a loss of the ability to correctly position the two halves of the DNA binding domain found at the N-termini of each protein chain.

In temperature sensitive transcription factors in which the temperature sensing domain is a globular interaction domain each monomer interacts with the corresponding portion of the other monomer through chemical and/or physical interactions at the core interface to form a globular temperature sensitive transcription factor. In those embodiments, cooperative unfolding of the monomers results in a loss of the ability to correctly position the two halves of the DNA binding domain found at the N-termini of each protein monomer.

In particular, temperature sensitive transcription factors herein described and more particularly in coiled coil and globular temperature sensing domain, the Tm of the temperature sensing domain defines the bioswitch temperature of the temperature sensitive transcription factor (Tbs) herein also indicated as threshold temperature, the Tbs being a temperature of the target environment at which the temperature sensitive transcription factor is converted from the DNA bound state to the DNA unbound state, with Tbs=Tm+0° C. to 5° C. In particular, Tbs=Tm+0° C. to 5° C. in a target environment with a net concentration of monomer proteins from 2 to 20 uM.

In some embodiments, the melting temperature Tm of the temperature sensing domain of a coiled coil or globular temperature sensing domain herein described can be Tm=from 20 to 80° C. In some embodiments, the melting temperature Tm of the temperature sensing domain of a coiled coil or globular temperature sensing domain herein described can be Tm=from 25 to 60° C. In some embodiments the melting temperature Tm of the temperature sensing domain of a coiled coil or globular temperature sensing domain herein described can be Tm=from 30 to 50° C. In some embodiments, the melting temperature Tm of the temperature sensing domain of a coiled coil or globular temperature sensing domain herein described can be Tm=from 32 to 46° C.

In some embodiments, the Tbs can be Tbs=Tm+2.5 to 5° C., wherein the temperature sensitive transcription factor is encoded in the target environment by a polynucleotide in a number from 100 to 1000 copies per cell. In some embodiments, the Tbs can be Tbs=Tm+1 to 3.5° C., wherein the temperature sensitive transcription factor is encoded in the target environment by a polynucleotide in a number from 10 to 100 copies per cell. In some embodiments, the Tbs can be Tbs=Tm+0 to 1.5° C., wherein the temperature sensitive transcription factor is encoded in the target environment by a polynucleotide in a number below 10 copies per cell.

The bioswitch temperature of temperature sensitive transcription factors affects the related bioswitch properties in a target environment wherein the temperature sensitive transcription factor's conversion from a DNA-bound state to n DNA-unbound state with respect to specific binding of the dimer to a DNA polynucleotide can be used to activate or inactivate expression of target genes possibly included in one or more genetic circuits.

In some embodiments, the bioswitch temperature of the coiled coil and globular transcriptional bioswitch dimers herein described can be increased or decreased through modification of the amino acid sequences of the temperature sensing domain to obtain temperature sensitive transcription factors that can operate at controlled temperatures.

In particular, thermal bioswitches operating at controlled temperature can be created by modifying the temperature sensing domain to result in modulation of the temperature response profile to higher or lower temperatures, as well as in changing the profile from a cooperative, switch-like induction to a linear "analog" transition. In some of those embodiments, a temperature sensitive transcription factor can be modified thermal transcriptional bioswitches can be mutated and "tuned" in the sense of the disclosure, to increase or decrease their bioswitch temperature Tbs and activate at different transition temperatures. In particular, in some embodiments, the thermal transcriptional bioswitches can be tuned to activate at new temperatures while retaining sharp, robust switching performance.

In particular, temperature sensing domain of the transcriptional bioswitch dimers obtainable with methods herein described can be configured so that the thermal bioswitches can be tuned to exhibit an ON or OFF state at a particular temperature range while still retaining a sharp thermal transition resulting in a large change in activity. For example, modification of the temperature sensing domain of a starting coiled coil or globular transcriptional bioswitch dimercan be performed to obtain a >100-fold difference between an on and off state, and a 10-fold switching over a temperature range less than 5° C. A modification of the temperature sensing domain of a coiled coil or transcriptional bioswitch dimers herein described can be performed to obtain a transcription factor with a Tbs bioswitch temperature that selected for specific application such as tunable thresholds within a biomedically relevant range of 32° C. to 46° C. Accordingly, one or more temperature sensitive transcription factor can be provided starting from coiled coil or globular transcriptional bioswitch dimers for use within a cell can be provided that are orthogonal to endogenous cellular machinery and compatible with other thermosresponsive components and a Tbs compatible with the cell physiological temperature to allow multiplexed thermal logic.

In some embodiments, tuning of the thermal response curve is achieved by modulating the affinity of the two coiled coil strands for each other. In those embodiments modification of a bioswitch temperature Tbs of a coiled coil temperature sensitive transcription factor can be performed by providing a coiled coil transcriptional bioswitch dimer herein described having a starting bioswitch temperature $Tbs_0$ in the target environment and two monomer proteins configured to form a temperature sensing domain in the target environment with a starting melting temperature $Tm_0$; and replacing in at least one monomer protein of the two monomer proteins forming the temperature sensing domain one or more residues in positions a, b, d, e and g of a heptad repeat in the temperature sensing amino acid sequence of the provided coiled coil temperature sensitive transcription factor.

In particular in some embodiments the replacing can be performed by replacing at least one of a hydrophobic amino acid in a position a and/or d of an heptad repeat of the temperature sensitive amino acid sequence of the temperature sensing domain with residues configured to increase or decrease hydrophobic packing between corresponding amino acid residues in positions a and/or d of the two monomer forming temperature sensing domain.

The term "hydrophobic packing" as used herein relates to the aggregating together of nonpolar molecules, and in particular, amino acids, to reduce the surface area exposed to water and minimize their disruptive effect. The efficiency of hydrophobic packing can be quantified by measuring the partition coefficients of non-polar molecules between water and non-polar solvents. The partition coefficients can be transformed to free energy of transfer which includes enthalpic and entropic components:

$$\Delta G = \Delta H - T \Delta S \qquad \text{Eq. 3}$$

where G is the Gibbs free energy of protein folding, H is the total enthalpy of a system, T is temperature, and S is entropy. These components can be experimentally determined using techniques such as calorimetry, circular dichroism or NMR, where an increase in $\Delta G$ indicates a decrease in efficiency of hydrophobic packing In some embodiments the replacing can be performed by replacing at least one polar or charged amino acid in position b e, and/or g of at least one heptad repeat of the temperature sensing domain amino acid sequence, with a hydrophobic residue, In some embodiments the replacing can be performed by replacing at least one polar or charged amino acid in positions e and/or g of at least one heptad repeat of the temperature sensing domain amino acid sequence with a residue configured to increase or decrease coulombic repulsion between corresponding residues in positions a, d, e and/or g of at least one heptad repeat of the temperature sensing domain amino acid sequence of the two monomers forming the temperature sensing domain.

In some embodiments the replacing can be performed by replacing one or more amino acid residues in anyone of positions a, b, d, e and/or g of at least one heptad repeat of the temperature sensing domain amino acid sequence as indicated above in combination one with the other.

In embodiments of the method to modify the amino acid sequences of the temperature sensing domain of coiled coil transcriptional bioswitch dimers herein described, the replacing is performed to obtain a variant of the coiled coil temperature sensitive transcription factor with a melting temperature of the temperature sensing domain $Tm_m$ lower or higher than $Tm_0$ in the target environment, the obtained variant having a bioswitch temperature $Tbs_m$ lower or higher than $Tbs_0$ in the target environment.

In particular, some of those embodiments coiled coil temperature sensitive transcription factors of the disclosure can be engineered to lower the bioswitch temperature Tbs of a starting coiled coil transcriptional bioswitch dimer, by replacing a polar amino acid in a position b of at least one heptad repeat of the temperature sensing domain amino acid sequence with a hydrophobic amino acid, a hydrophobic amino acid in a position d at least one heptad repeat of the temperature sensing domain amino acid sequence with a polar amino acid, a charged amino acid in a position e at least one heptad repeat of the temperature sensing domain amino acid sequence with a charged amino acid having a pKa different from the original by equal or higher than 0.5 or at least one of a hydrophobic amino acid in a position a, a hydrophobic amino acid in a position d, a charged amino acid in a position e and a charged amino acid in a position g in at least one heptad repeat of the temperature sensing domain amino acid sequence with amino acid residues such that pairs formed by corresponding residues in positions a, d, e, and g on the two monomer protein interact with a coulombic force F≥1 pN, wherein $$F = k_e \frac{q_1 q_2}{r^2} \qquad \text{Eq. (4)}$$

where $k_e$ is Coulomb's constant (k=8.99×10$^9$ N m$^2$ C$^{-2}$), $q_1$ and $q_2$ are the signed magnitudes of the charges on each amino acid residue of the pair of residues, and the scalar r is the distance between the charges Exemplary variants of coiled coil transcriptional bioswitch dimers herein described having a lower bioswitch temperature with respect to a starting coiled coil temperature sensitive transcription factor, and obtainable methods herein described comprise dimers comprising a coiled coil temperature sensing domain of sequence SEQ ID NO: 1 to SEQ ID NO: 456 possibly with a 0% to 20% variation and including at least one of the replacement herein described in one or more of the amino acid residues in positions a, b, d e and g of at least one heptad repeat in the sequence that lower the bioswitch temperature Tbs of the coiled coil transcriptional bioswitch dimers.

Specific variants lowering threshold temperature of WT TlpA which has a threshold transcriptional activation temperature Tbs above 43° C. can be provided starting from a WT TlpA which has a threshold transcriptional activation temperature Tbs above 43° C. and mutating P60L, D135V (replacing a polar amino acid b in the TlpA WT sequence with a hydrophobic amino acid), K187R K187R (replacing the charged amino acid e in the TlpA WT sequence with an amino acid residue such that pairs formed by residue e on one of the two TlpA monomer units with residue g on another monomer unit interact with a stronger coulombic force), K202I, L208Q (replacing core hydrophobic residue d in the TlpA WT sequence with a polar residue to decrease hydrophobic packing) in TlpA ("TlpA$_{36}$") to provide a bioswitch with a threshold transcriptional activation temperature centered at 36° C. Mutating D135V (replacing a polar amino acid in position b in the TlpA WT sequence with a hydrophobic amino acid), A217V, L236F (replacing core hydrophobic residue d in the TlpA WT sequence with another hydrophobic residue with less efficient packing) ("TlpA$_{39}$"), generates another bioswitch with a threshold transcriptional activation temperature centered at 39° C. (see Examples 1-2).

In some embodiments coiled coil transcriptional bioswitch dimers herein described can be engineered to increase the bioswitch temperature Tbs of a starting coiled coil temperature sensitive transcriptional bioswitch, by replacing at least one of a hydrophobic amino acid in a position a and the hydrophobic amino acid in a position d of at least one heptad repeat of the temperature sensing amino acid sequence, with a polar amino acid or a charged amino acid, and/or at least one of a hydrophobic amino acid in a position a, a hydrophobic amino acid in a position d, a charged amino acid in a position e and a charged amino acid in a position g of at least one heptad repeat of the temperature sensing amino acid sequence with amino acid residues such that pairs formed by corresponding residues in positions a, d, e, and g on the two monomers interact with a coulombic force F≤1 pN calculated according to Equation 3.

Exemplary variants of coiled coil transcriptional bioswitch dimers herein described having a higher bioswitch temperature with respect to a starting coiled coil transcriptional bioswitch dimer, and obtainable methods herein described comprise dimers comprising a coiled coil temperature sensing domain of sequence SEQ ID NO: 1 to SEQ ID NO: 456 possibly with a 0% to 20% variation and including at least one of the replacement herein described in one or more of the amino acid residues in positions a, b, d e and g of at least one heptad repeat in the sequence that increases the bioswitch temperature Tbs of the coiled coil transcriptional bioswitch dimers.

In some embodiments in which the temperature sensing domain is a dimer of two monomers, each containing a globular structure having a core interface and exterior solvent exposed face, tuning of the thermal response curve is achieved by modulating the affinity of the two monomers.

In particular, amino acid residues at the interface the globular temperature sensing domain and/or solvent exposed residues of the globular temperature sensing domain can be replaced with polar or more or less polar residues, charged or more or less charged residues, hydrophobic or more or less hydrophobic residues, or bulky or more or less bulky residues which are identifiable a skilled person upon reading of the present disclosure.

In particular some embodiments, shifting the threshold temperature Tbs of globular temperature sensitive bioswitch dimer to lower temperatures is accomplished by replacing solvent exposed residues in SEQ ID NO:457 with more non-polar residues to destabilize the protein. Polar residues exposed to the solvent that can be replaced with more non-polar residues comprise the following: X3 to X5, X16 to X17, X23 to X24, X6 to X8, and X9. Residues exposed to the solvent that can be any amino acid and can be replaced with more nonpolar residues comprise: X33, X42 to X44, X45 to X46, X53, X54 to X56, X57 to X60, X67 to X69, and X70.

In some embodiments, shifting the threshold temperature Tbs of globular temperature sensitive bioswitch dimer to lower temperatures is accomplished by replacing nonpolar residues at the interface between the two monomers in SEQ ID No:457 with more polar residues to destabilize the protein. In some embodiments, shifting the threshold to lower temperatures is accomplished by replacing nonpolar residues at the interface between the two monomers in SEQ ID NO:457 with larger residues resulting in less efficient packing and destabilization of the protein. Nonpolar residues at the interface between the two monomers that can be replaced with more polar residues or with larger residues comprise the following: X25, X34 to X37, X47. Polar, nonpolar or ionic residues at the interface between the two monomers that can be replaced with more polar residues or with larger residues comprise the following: X31 to X32, X48 to X52. Polar or ionic residues at the interface between two monomers that can be replaced with more polar residues or with larger residues comprise the following: X89 to X96. Polar or non-polar residues at the interface between two monomers that can be replaced with more polar residues or with larger residues comprise the following: X20 to X22, X28 to X30, X97 to X100, X104 to X105.

In some embodiments, shifting the threshold temperature Tbs of globular temperature sensitive bioswitch dimer to lower temperatures is accomplished by replacing polar residues at the interface between the two monomers in SEQ ID NO:457 with more polar residues to destabilize the protein. In some embodiments, shifting the threshold to lower temperatures is accomplished by replacing polar residues at the interface between the two monomers in SEQ ID NO:457 with larger residues resulting in less efficient packing and destabilization of the protein. Polar residues at the interface between the two monomers that can be replaced with more polar residues or with larger residues comprise the following: X1, X2, X77 to X78, X79, X80 to X81, X82, X83 to X88.

In some embodiments, shifting the threshold temperature Tbs of globular temperature sensitive bioswitch dimer to lower temperatures is accomplished by replacing ionic residues at the interface between the two monomers in SEQ ID NO:457 with nonionic residues to destabilize the protein. Polar, non-polar, or ionic residues at the interface between the two monomers that can be replaced with non-ionic residues comprise the following: X31 to X32, X48 to X52. Polar or ionic residues at the interface between the two monomers that can be replaced with non-ionic residues comprise the following: X89 to X96.

In some embodiments, shifting the threshold temperature Tbs of globular temperature sensitive bioswitch dimer to lower temperatures is accomplished by replacing ionic residues near the interface between the two monomers of SEQ ID NO: 457 which do not apparently form polar/ionic contacts with the other monomer with less polar residues to destabilize the protein. Polar or ionic residues participating in interactions at the interface between the two monomers that can be replaced with less polar residues comprise the following: X26 to X27.

In some of these embodiments, shifting the threshold temperature Tbs of globular temperature sensitive bioswitch dimer to lower temperatures is accomplished by replacing polar residues at the interface in SEQ ID NO:457 with different (e.g. bulkier) polar residues that are sterically inhibited from forming polar contacts as efficiently as in the original protein. Polar, non-polar, or ionic residues at the interface between the two monomers that can be replaced with different (e.g. bulkier) polar residues comprise the following: X31 to X32, X48 to X52. Polar or ionic residues at the interface between the two monomers that can be replaced with different (e.g. bulkier) polar residues comprise the following: X89 to X96.

The term "bulkiness" as used herein, in particular in relation to amino acids, refers to the molecular weight of an amino acid, wherein amino acids of higher molecular weight are more bulky. The molecular weight of the twenty common amino acids is shown in FIG. 24. Amino acids of MW of 140 g/mol can be considered "bulky", whereas amino acids of MW below 140 g/mol can be considered not to be bulky. Thus, for example, replacement of a hydrophobic amino acid with a more bulky hydrophobic amino acid in a polypeptide or protein can change the structure of a polypeptide or protein, or protein-protein interactions, and related functional characteristics of the polypeptide or protein, such as efficiency of hydrophobic packing, or others as understood by a skilled person.

In some embodiments, a Polar or ionic residues at residue in the N-terminal DNA binding domain can be replaced with a different (e.g. bulkier). For example, in TcI, residue K68 can be mutated to R to shift the threshold from 0 C to 3 C (FIG. 7i).

In some of embodiments, shifting the threshold temperature Tbs of globular temperature sensitive bioswitch dimer to lower temperatures is accomplished by replacing nonpolar residues at the interface between the two monomers in SEQ ID NO:457 with bulky sterically occluded, polar, or ionic residues to disrupt the interaction. Polar or non-polar residues at the interface between the two monomers that can be replaced with bulky sterically occluded, polar, or ionic residues comprise the following: X20 to X22, X28 to X30, X97 to X100, X104 to X105. Nonpolar residues at the interface between the two monomers that can be replaced with bulky sterically occluded, polar, or ionic residues comprise the following: X25, X34 to X37, and X47.

In some of embodiments, shifting the threshold temperature Tbs of globular temperature sensitive bioswitch dimer to lower temperatures is accomplished by destabilizing the state of the folded structure by replacing solvent-exposed polar or ionic residues in SEQ ID NO:457 with hydrophobic residues. Solvent-exposed polar residues that can be replaced with hydrophobic residues comprise the following: X3 to X5, X16 to X17, X23 to X24, X6 to X8, and X9. Solvent exposed residues that can be any amino acid and can be replaced with hydrophobic residues comprise the following: X33, X42 to X44, X45 to X46, X53, X54 to X56, X57 to X60, X67 to X69, and X70.

In some embodiments, shifting the threshold temperature Tbs of globular temperature sensitive bioswitch dimer to lower temperatures is accomplished by destabilizing the state of the folded structure by replacing polar residues X101 to X103 of SEQ ID NO: 457 that are coordinated with each other via hydrogen bonding with nonpolar residues in the globular temperature sensing domain.

In some embodiments, shifting the threshold temperature Tbs of globular temperature sensitive bioswitch dimer to higher temperatures is accomplished by replacing solvent exposed residues in SEQ ID NO: 457 with more polar residues to stabilize the protein. Solvent-exposed polar residues that can be replaced with more polar residues comprise the following: X3 to X5, X16 to X17 X23 to X24, X6 to X8, X9. Solvent exposed residues that can be any amino acid and can be replaced with more polar residues comprise the following: X33, X42 to X44, X45 to X46, X53, X54 to X56, X57 to X60, X67 to X69, and X70.

In some embodiments, shifting the temperature Tbs of globular temperature sensitive bioswitch dimer to higher temperatures is accomplished by replacing nonpolar residues at the interface between the two monomers in SEQ ID NO:457 with more non-polar residues to stabilize the protein. Nonpolar residues at the interface between the two monomers that can be replaced with more nonpolar residues comprise the following: X25, X34 to X37, X47. Polar, nonpolar or ionic residues at the interface between the two monomers that can be replaced with more nonpolar residues comprise the following: X31 to X32, X48 to X52. Polar or ionic residues at the interface between two globular monomers that can be replaced with more nonpolar residues comprise the following: X89 to X96. Polar or non-polar residues at the interface between two monomers that can be replaced with more nonpolar residues comprise the following: X20 to X22, X28 to X30, X97 to X100, X104 to X105.

In some embodiments, shifting the threshold to higher temperatures is accomplished by replacing polar residues at the interface between the two monomers in SEQ ID NO:457 with more non-polar to stabilize the protein. Polar residues at the interface between the two monomers that can be replaced with more nonpolar residues comprise the following: X1, X2, X77 to X78, X79, X80 to X81, X82, X83 to X88.

In some embodiments, shifting the threshold temperature Tbs of globular temperature sensitive bioswitch dimer to higher temperatures is accomplished by replacing ionic residues near the interface between the two monomers which do not apparently form polar/ionic contacts with the other monomer in SEQ ID NO:457 with more polar residues to stabilize the protein. Polar or ionic residues participating in interactions at the interface between the two monomers that can be replaced with more polar residues comprise the following: X26 to X27.

In some of embodiments, shifting the threshold temperature Tbs of globular temperature sensitive bioswitch dimer to higher temperatures is accomplished by minimizing entropy of the folded structure by replacing geometrically constrained residues with smaller residues containing less degrees of freedom while maintaining the energetic contribution of the polar contacts.

In some embodiments, a geometrically constrained residues in the N-terminal DNA binding domain can be replaced with a smaller residue containing less degrees of freedom while maintaining the energetic contribution of the polar contacts For example, in TcI, residue K6 can be mutated to N to shift the threshold temperature (FIG. 7j).

In some of embodiments, shifting the threshold temperature to higher temperatures is accomplished by replacing by replacing hydrophobic (nonpolar) residues at the dimerization interface with other hydrophobic (nonpolar) variants that optimize van-der-Waals contact area. Nonpolar residues at the interface between the two monomers that can be replaced with other hydrophobic (nonpolar) variants that optimize van-der-Waals contact area comprise the following: X25, X34 to X37, X47. Polar, nonpolar or ionic residues at the interface between the two monomers that can be replaced with other hydrophobic (nonpolar) variants that optimize van-der-Waals contact area comprise the following: X31 to X32, X48 to X52. Polar or ionic residues at the interface between two monomers that can be replaced with other hydrophobic (nonpolar) variants that optimize van-der-Waals contact area comprise the following: X89 to X96. Polar or non-polar residues at the interface between two monomers that can be replaced with other hydrophobic (nonpolar) variants that optimize van-der-Waals contact area comprise the following: X20 to X22, X28 to X30, X97 to X100, X104 to X105.

Alternatively, shifting the threshold temperature Tbs of globular temperature sensitive bioswitch dimer to higher temperatures is accomplished by replacing residues surrounding the dimerization interface to charge-or-polarity-complemented pairs. Polar or ionic residues participating in interactions at the interface between the two monomers that can be replaced with charge- or polarity-complemented pairs comprise the following: X26 to X27.

In some embodiments, the threshold temperature Tbs of globular temperature sensitive bioswitch dimer can be increased or decreased by replacing in at least one monomer protein of the two monomer proteins forming the temperature sensing domain any amino acid residues of SEQ ID NO: 457 and in particular of SEQ ID NO: 459 to have a substitution selected using ΔΔG of substitution and/or ΔΔG of folding of the Rosetta modeling software that increases or decreases the related Tm and therefore the Tbs as herein described.

In some embodiments of the globular temperature sensing domain, each monomer protein can have a globular temperature sensing amino acid sequence TTKKASDSAFWLEVEGNSMTAPTGSKPSFPDGMLILVDPEQAVEPGDFCIARLGGDEFTFK KLIRDSGQVFLQPLNPQYPMIPCNESCSVVGKVIASQWPEETFG (SEQ ID NO: 459), or a variant of SEQ ID NO: 457 in which any of the amino acid residues of SEQ ID NO: 459 is substituted with a ΔΔG of substitution greater than 0.5 Rosetta Energy Unit (REU) or lower than −0.5 Rosetta Energy Unit (R.E.U).

In some embodiments of the globular temperature sensing domain, each monomer protein can have a variant of the globular temperature sensing amino acid sequence TTKKASDSAFWLEVEGNSMTAPTGSKPSFPDGMLILVDPEQAVEPGDFCIARLGGDEFTFKKLIRD SGQVFLQPLNPQYPMIPCNESCSVVGKVIASQWPEETFG (SEQ ID NO: 459), in which one or more amino acid substitutions decreases the ΔG by >0.5-10, 0.5-5 or preferably 1-4 of Rosetta energy units (REU), thus leading to a variant with upshifted Tm. In such scenario, the ΔΔG has a negative value in a range from −0.5 to −10, or −0.5 to −5, or −1 to −4.

In some embodiments of the globular temperature sensing domain, each monomer protein can have a variant of the globular temperature sensing amino acid sequence TTKKASDSAFWLEVEGNSMTAPTGSKPSFPDGMLILVDPEQAVEPGDFCIARLGGDEFTFKKLIRD SGQVFLQPLNPQYPMIPCNESCSVVGKVIASQWPEETFG (SEQ ID NO: 459), in which one or more amino acid substitution increases the ΔG by >0.5-10, 0.5-5 or preferably 1-4 of Rosetta energy units (REU), thus leading to a variant with downshifted Tm. In such scenario, the ΔΔG has a positive value in a range from 0.5 to 10, or 0.5 to 5, or 1 to 4.

In particular, variants of globular temperature sensitive transcription factors, having a globular temperature sensing amino acid sequence SEQ ID NO: 457 and in particular of SEQ ID NO: 459 can be performed by predicting the possible mutations in the globular temperature sensing domain interface that are stabilizing or neutral, and predicting the energy of all possible mutations in the amino acid sequence SEQ ID NO: 457 and in particular of SEQ ID NO: 459.

In some embodiments herein described, predicting the possible mutations in the globular temperature sensing domain interface can be performed by running the Rosetta interface plasticity prediction as described above (application 3 in Lauck et al. (2010) [27] and selecting for all mutations predicted with frequency >0, consider these mutations stabilizing or neutral. In particular, running Rosetta interface plasticity prediction can be performed with the following Inputs: Crystal structure (for example, PDB code 3BDN), Interacting chain IDs (chain a and chain b), Residues which are interacting to obtain the following outputs: Sequences of variants which are predicted to function and relative frequencies of variants which are predicted to function.

In some embodiments herein described, predicting the energy of all possible mutations in the amino acid sequence SEQ ID NO: 457 and in particular of SEQ ID NO: 459 can be performed by running the Rosetta point mutation modeling prediction (application I in Lauck et al. (2010) [27] for the predicted possible mutations, then determine the change in R.E.U. (ΔΔG) and select the variants with associated R.E.U. ranges herein described.

The thermal transcriptional bioswitch herein described can encompass other proteins that operate on similar principles as TlpA or TcI. These include highly homologous proteins, such as the Coiled coil DNA binding protein KfrA, and engineered constructs such as a previously reported synthetic protein in which the Lambda cI binding domain is grafted onto the GCN4 coiled coil [32].

In some embodiments, a WT TcI has a threshold temperature of about 40° C. and mutating M1V, L65S, K68R, F115L, D126G, D188G in TcI ("TcI$_{38}$") generates a bioswitch with a threshold transcriptional activation centered at 38° C. In another embodiment, mutating K6N, S33T, Y61H, L119P, F122C ("TcI$_{42}$"), generates another bioswitch with a threshold transcriptional activation centered at 42° C. (see Examples 1-2).

Coiled coil and globular thermal transcriptional bioswitch herein described can encompass other proteins that operate on similar principles as TlpA or TcI. These include proteins highly homologous to TlpA or TcI, such as the coiled coil DNA binding protein KfrA, and engineered constructs such as a previously reported synthetic protein in which the Lambda cI binding domain is grafted onto the GCN4 coiled coil [32].

In some embodiments, the thermal bioswitches comprising coiled coil transcriptional bioswitch dimers such as TlpA and/or globular transcriptional bioswitch dimers such as TcI repressor families herein described can be used to activate or inactivate gene expression in the biomedically relevant range of 32 to 46° C. while demonstrating a dynamic range similar to that of the wild-type protein (Table 1). In particular, transcriptional bioswitch dimers can be provided based on TlpA or other coiled coil transcriptional bioswitch dimer, or TcI or other globular transcriptional bioswitch dimers, that have a sharp thermal transition resulting in a large change in activity i.e. >100-fold over a few degrees, and a switching temperature Tbs tunable to enable a broad range of applications. In addition, the bioswitches are orthogonal to endogenous cellular machinery and compatible with other thermos-responsive components to allow multiplexed thermal logic.

In particular, in some embodiments, the temperature sensitive transcription factors herein described, and in particular the coiled coil and/or globular transcriptional bioswitch dimers herein described, can be integrated into thermal logic circuits to control multiple functions at different desired temperatures or confine activity to within a narrow thermal range.

The term "logic circuit", "genetic circuit" or "circuit," as used herein indicates a collection of molecular components (herein also indicated as nodes) connected one to another by biochemical reactions according to a circuit design. In particular, in a genetic circuit the molecular components are connected one to another by the biochemical reactions so that the collection of molecular components is capable to provide a specific output in response to one or more inputs. The term biochemical reactions as used herein comprise The term "molecular component" or "node" as used herein in connection with the genetic circuit indicates a chemical compound comprised in a cellular environment. Exemplary molecular components thus comprise polynucleotides, such as ribonucleic acids or deoxyribonucleic acids, polypeptides, amino acids, and/or other small or large molecules and/or polymers that can be found in a cellular environment.

In genetic circuits in the sense of the present disclosure, the molecular components forming parts of the genetic circuit are genetic molecular components. The term "genetic molecular component" as used herein indicates a molecular unit formed by a gene, an RNA transcribed from the gene or a portion thereof and optionally a protein translated from the transcribed RNA. In genetic circuits herein described, the biochemical reactions connecting the genetic molecular component to another molecular component of the circuit can involve any one of the gene, the transcribed RNA and/or the polypeptide forming the molecular component.

A gene comprised in a genetic molecular component is a polynucleotide that can be transcribed to provide an RNA and typically comprises coding regions as well as one or more regulatory sequence regions which is a segment of a nucleic acid molecule which is capable of increasing or decreasing transcription or translation of the gene within an organism either in vitro or in vivo. In particular, coding regions of a gene herein described can comprise one or more protein coding regions which when transcribed and translated produce a polypeptide, or if an RNA is the final product, only a functional RNA sequence that is not meant to be translated. Regulatory regions of a gene herein described comprise promoters, transcription factor binding sites, operators, activator binding sites, repressor binding sites, enhancers, protein-protein binding domains, RNA binding domains, DNA binding domains, silencers, insulators and additional regulatory regions that can alter gene expression in response to developmental and/or external stimuli as will be recognized by a person skilled in the art.

A protein comprised in a molecular component can be proteins with activating, inhibiting, binding, converting, or reporting functions. Proteins that have activating or inhibiting functions typically act on operator sites encoded on DNA, but can also act on other molecular components. Proteins that have binding functions typically act on other proteins, but can also act on other molecular components. Proteins that have converting functions typically act on small molecules, and convert small molecules from one small molecule to another by conducting a chemical or enzymatic reaction. Proteins with converting functions can also act on other molecular components. Proteins with reporting functions have the ability to be easily detectable by commonly used detection methods (absorbance, fluorescence, for example), or otherwise cause a reaction on another molecular component that causes easy detection by a secondary assay (eg. adjusts the level of a metabolite that can then be assayed for). The activating, inhibiting binding, converting, or reporting functions of a protein typically form the interactions between genetic components of a circuit. Exemplary proteins that can be comprised in a genetic molecular component comprise monomeric proteins and multimeric proteins, proteins with tertiary or quaternary structure, proteins with linkers, proteins with non-natural amino acids, proteins with different binding domains, and other proteins known to those skilled in the art. Specific exemplary proteins include TetR, LacI, LambdaCI, PhlF, SrpR, QacI, BetR, LmrA, AmeR, LitR, met, AraC, LasR, LuxR, IpgC, MxiE, Gal4, GCN4, GR, SP 1, CREB, and others known to a skilled person in the art.

In some embodiments of genetic circuits herein described, one or more molecular components is a recombinant molecular component that can be provided by genetic recombination (such as molecular cloning) and/or chemical synthesis to bring together molecules or related portions from multiple sources, thus creating molecular components that would not otherwise be found in a single source.

In embodiments of the thermal logic circuits herein described, a thermal logic circuit comprises one or more genetic molecular component, connected one to another in accordance to a circuit design by activating, inhibiting, binding or converting reactions to form a fully connected network of interacting components. in which at least one genetic molecular component is under control of a temperature sensitive transcription factor herein described.

The term "activating" as used herein in connection with a molecular component of a genetic circuit refers to a reaction involving the molecular component which results in an increased presence of the same or a different molecular component in the cellular environment. For example, activation of a genetic molecular component indicates one or more reactions involving the gene, RNA and/or protein of the genetic molecular component resulting in an increased presence of the gene, RNA and/or protein of the same or a different genetic molecular component (e.g. by increased expression of the gene of the molecular component, and/or an increased translation of the RNA). An example of activation of a genetic molecular component of a genetic circuit comprises the expression of a target gene upon exposure to a specific range of temperatures.

The term "inhibiting" as used herein in connection with a molecular component of a genetic circuit refers to a reaction involving the molecular component of the genetic circuit and resulting in a decreased presence of the same or a different molecular component in the cellular environment. For example, inhibition of a genetic molecular component indicates one or more reactions involving the gene, RNA and/or protein of the genetic molecular component resulting in a decreased presence of the same or a different gene, RNA and/or protein (e.g. by decreased expression of the gene of the molecular component, and/or a decreased translation of the RNA). An example of inhibition of a genetic molecular component of a genetic circuit comprises the reaction of a repressing protein (eg. TlpA or TcI) that reduces the expression of a gene controlled by a TlpA or TcI promoter.

The term "binding" as used herein in connection with molecular components of a genetic circuit refers to the connecting or uniting two or more molecular components of the circuit by a bond, link, force or tie in order to keep two or more molecular components together, which encompasses either direct or indirect binding where, for example, a first molecular component is directly bound to a second molecular component, or one or more intermediate molecules are disposed between the first molecular component and the second molecular component another molecular component of the circuit. Exemplary bonds comprise covalent bond, ionic bond, van der waals interactions and other bonds identifiable by a skilled person. In some embodiments, the binding can be direct, such as the production of a polypeptide scaffold that directly binds to a scaffold-binding element of a protein. In other embodiments, the binding can be indirect, such as the co-localization of multiple protein elements on one scaffold. In some instances binding of a molecular component with another molecular component can result in sequestering the molecular component, thus providing a type of inhibition of said molecular component. In some instances binding of a molecular component with another molecular component can change the conformation or function of the molecular component, as in the case of allosteric interactions between proteins or dimerization between two monomers, thus providing a type of activation or inhibition of the bound component.

In embodiments of a genetic circuit, the molecular components are connected one with another according to a circuit design in which a molecular component is an input and another molecular component is an output. In particular, a genetic circuit typically has one or more input or start molecular component which activates, inhibits, and/or binds another molecular component, one or more output or end molecular component which are activated, inhibited, bound and/or converted by another molecular component, and intermediary molecular components each inhibiting, binding and/or converting another molecular component and being activated, inhibited, bound and/or converted by another molecular component.

In embodiments herein described, the molecular components are typically connected together according to the circuit design in defined patterns of interactions between components called circuit motif. A circuit motif typically has inputs and outputs and performs an information processing function that is one level higher than recombinant genetic components.

Exemplary circuit motifs that can be used to connect collections of molecular components in a genetic circuit according to a circuit design comprise a feed-forward loop (wherein the output is a pulse) [33], an oscillator (wherein the output is an oscillatory output) [34], a repression cascade (wherein the output is repression of the expression of a molecular component of the circuit) [35], a switch (wherein the output is expression of either one molecular component of the circuit in response to one input or another molecular component of the circuit in response to another input) [36] (see Examples 2-4 and FIG. 8). or a cascade (wherein the circuit transmits the input signal to an output signal) [37], and other circuit designs which will be identifiable by a skilled person upon reading of the present disclosure.

Genetic circuits in the sense of the disclosure can comprise more than one circuit motif and in particular two or more circuit motifs as will be understood by a skilled person.

In some embodiments, the transcriptional activity of a transcription regulatory factor can be modified by molecular modifications made to a protein that change its conformation and affects the activity of the protein as it pertains to inhibition, activation, sequestration, acting on a substrate or other biomolecular functions; mutations to proteins in which a molecular component binds to a protein and changes its conformation or dimerization state resulting in a change of activity as will be understood by a person skilled in the art.

In some embodiments, the transcription regulatory factors of the thermal logic circuit are thermal transcriptional bioswitches herein described comprising a DNA-binding domain and a temperature-sensing domain. Upon exposure to a specific temperature range, the temperature sensing domain can cooperatively modulate the assembly of two polypeptide chains each having a globular structure or single-stranded coil into a functional dimer. The correctly configured dimer can then bind to the a promoter sequence and represses the transcription output of the system either by occluding the binding site for RNA polymerase or by impeding the 5' to 3' motion of the RNA polymerase along the DNA.

In the genetic circuits herein described at least one molecular component of the circuit can be a reportable molecular component detectable in a cell-free system and/or in a target environment when the genetic circuit operates according to the circuit design.

The term "reportable molecular component" as used herein indicates a molecular component capable of detection in one or more systems and/or environments. The terms "detect" or "detection" as used herein indicates the determination of the existence, presence or fact of a target in a limited portion of space, including but not limited to a sample, a reaction mixture, a molecular complex and a substrate. The "detect" or "detection" as used herein can comprise determination of chemical and/or biological properties of the target, including but not limited to ability to interact, and in particular bind, other compounds, ability to activate another compound and additional properties identifiable by a skilled person upon reading of the present disclosure. The detection can be quantitative or qualitative. A detection is "quantitative" when it refers, relates to, or involves the measurement of quantity or amount of the target or signal (also referred as quantitation), which includes but is not limited to any analysis designed to determine the amounts or proportions of the target or signal. A detection is "qualitative" when it refers, relates to, or involves identification of a quality or kind of the target or signal in terms of relative abundance to another target or signal, which is not quantified.

In some embodiments of the genetic circuit according to the disclosure, the reportable molecular component can be a molecular component linked or comprising a label wherein the term label refers to a compound capable of emitting a labeling signal, including but not limited to radioactive isotopes, fluorophores, chemiluminescent dyes, chromophores, enzymes, enzymes substrates, enzyme cofactors, enzyme inhibitors, dyes, metal ions, nanoparticles, metal sols, ligands (such as biotin, avidin, streptavidin or haptens) and the like. The term "fluorophore" refers to a substance or a portion thereof which is capable of exhibiting fluorescence in a detectable image as seen for fluorescent reporter GFP and RFP in Examples 2-4. As a consequence, the wording "labeling signal" as used herein indicates the signal emitted from the label that allows detection of the label, including but not limited to radioactivity, fluorescence, chemiluminescence and the like.

Accordingly, in genetic circuit of the disclosure, operativeness of the genetic circuit can be detected by detecting the reportable molecular component of the thermal logic circuit in vivo or in vitro when the genetic circuit operates according to the circuit design.

In embodiments, herein described, temperature sensitive genetic circuit comprise at least one genetic molecular component under regulation of at least one of the coiled coil and/or globular transcription bioswitch dimers herein described and/or of at least one of other temperature sensitive transcription factors known or identifiable by a skilled person.

Additional temperature sensitive or thermal genetic circuit are also described herein in which at least one genetic molecular component is under regulation of at least one of the coiled coil and/or globular temperature sensitive transcription factors herein described and/or of at least one of other temperature sensitive transcription factors known or identifiable by a skilled person.

Exemplary other temperature switches known or identifiable by a skilled person comprise cI mutant from Phage L1 (bioswitch temperature is between 35-38° C.; globular) [38], cI mutant from Phage P1 (bioswitch temperature is ~40° C.; globular) [39], c repressor from Phage Mu (bioswitch temperature is between 30° C.-42° C.) [40], RheA (bioswitch temperature between 37° C.-41° C.; note: is a dimer, but switching does not seem to be caused by conversion to monomer) [41], GmaR (bioswitch temperature between 22° C.-34° C.; structure is alpha-helical/random) [42], Temperature Sensitive LacI variants: Gly187Ser (bioswitch temperature is 42° C.), Ala241Thr (bioswitch temperature is 40° C.), Gly265Asp (bioswitch temperature is 37° C.); alpha-helical C-terminal tetramerization domain) [43]. Temperature Sensitive TetR variants: High tetR expressors of G21E (bioswitch temperature is between 28° C. and 37° C.), A89D (bioswitch temperature is ~37° C.), I193N (bioswitch temperature is between 37° C.-42° C.). Low tetR expressors were repressed at all temperatures. [44], and RovA (bioswitch temperature is between 25° C. and 37° C.; structure is alpha-helical/beta-sheet/random) [45]. Additional temperature sensitive switches capable of being used in temperature sensitive genetic circuit herein described, are identifiable by a skilled person.

In some embodiments of thermal genetic circuits or temperature sensitive genetic circuits herein described, molecular components can be connected to form one or more circuit motifs within the thermal genetic circuit and at least one component of at least one circuit motifs is configured to be under regulation of a temperature sensitive transcription factor herein described.

In some embodiments, the thermal circuit can comprise one circuit motif that further comprises a thermal transcriptional bioswitch herein described, a promoter, and a reportable molecular component as shown in the example of FIG. 2a. The thermal transcriptional bioswitch can be a coiled coil temperature sensitive transcriptional factor such as TlpA and/or a variant thereof, and/or globular temperature sensitive transcriptional factors such as TcI and/or a variant thereof, or other temperature sensitive transcriptional factors that can be identified by a person of ordinary skill in the art. The promoter can be a heat-shock promoter such as pTSR, pHSP, pR-pL, GrpE, HtpG, Lon, RpoH, Clp, DnaK and other heat-shock promoters as will be understood by a skilled person in the art. The reportable molecular component can be a fluorescent reporter such as GFP and RFP.

In some embodiments, thermal genetic circuits of the disclosure can be designed to comprise two or more circuit motifs, each motif comprising a thermal transcriptional bioswitch herein described, a promoter, and a reportable molecular component, in which the thermal transcriptional bioswitch can be a coiled coil temperature sensitive transcriptional factor such as TlpA and/or a variant therefore and/or globular temperature sensitive transcriptional factors such as TcI and/or a variant thereof or other temperature sensitive transcriptional factors that can be identified by a person of ordinary skill in the art.

In some embodiments, one or more molecular components of the thermal genetic circuits herein described can be a temperature sensitive transcription factor such as a coiled coil transcriptional bioswitch dimers such as TlpA and/or a variant thereof and/or globular transcriptional bioswitch dimer such as TcI and/or a variant thereof. For example, temperature sensitive transcription factors herein described can be used in a temperature sensitive genetic circuit to be operated in a target environment at at least two target temperatures. The temperature sensitive genetic circuit comprises one or more molecular components connected one to another by biochemical reactions according to a circuit design. In the temperature sensitive genetic circuit, at least one of the molecular components is a temperature sensitive genetic molecular components comprising a coiled coil and/or globular temperature sensitive transcription factor herein described having a bioswitch temperature Tbs in the target environment equal to one of the at least two target temperatures. In the temperature sensitive genetic circuit, each of the temperature sensitive genetic molecular component is configured to activate or inhibit another genetic molecular component of the genetic circuit at a temperature sensitive molecular component bioswitch temperature equal to the bioswitch temperature Tbs of the coiled coil and/or globular temperature sensitive transcription factor.

In particular, in some embodiments temperature sensitive genetic circuits comprising thermal transcription bioswitches possibly including coiled coil or globular temperature sensitive transcription factors herein described can operate at a target environment temperature equal to a bioswitch temperature Tbs from 20 to 39° C.

In particular in some embodiments, in a temperature sensitive genetic circuit herein described, at least one of the temperature sensitive genetic molecular components of the genetic circuit is configured to activate or inhibit another molecular component of the genetic circuit at a temperature sensitive molecular component bioswitch temperature equal to the bioswitch temperature Tbs 20 to 39° C.

In some embodiments, in a temperature sensitive genetic circuit herein described, at least one of the temperature sensitive genetic molecular components of the genetic circuit is configured to activate or inhibit another molecular component of the genetic circuit at a temperature sensitive molecular component bioswitch temperature equal to the bioswitch temperature Tbs from 32 to 39° C.

In some embodiments, in a temperature sensitive genetic circuit herein described, at least one of the temperature sensitive genetic molecular components of the genetic circuit is configured to activate or inhibit another molecular component of the genetic circuit at a temperature sensitive molecular component bioswitch temperature equal to the bioswitch temperature Tbs from 41 to 43° C.

In some embodiments, in a temperature sensitive genetic circuit herein described, at least one of the temperature sensitive genetic molecular components of the genetic circuit is configured to activate or inhibit another molecular component of the genetic circuit at a temperature sensitive molecular component bioswitch temperature equal to the bioswitch temperature Tbs from 45 to 80° C.

For example, as shown in the Examples section, the thermal genetic circuit comprising a thermal transcriptional bioswitch of TlpA WT, variants TlpA36 and TlpA39 can be turned on at temperatures of 43° C., 36° C., and 39° C. respectively.

In some embodiments, a temperature sensitive multiplexed genetic circuit can be designed to be operated in a target environment at at least two different target temperatures. The temperature sensitive multiplexed genetic circuit comprises one or more molecular components connected one to another by biochemical reactions according to a circuit design. In the multiplexed genetic circuit at least two genetic molecular components are temperature sensitive molecular components, each configured to activate or inhibit another molecular component of the genetic circuit at a temperature sensitive molecular component bioswitch temperature.

In the multiplexed temperature sensitive genetic circuit, at least one first temperature sensitive molecular component is configured to activate or inhibiting a first molecular component at a first bioswitch temperature $Tbs_1$, and at least one second temperature sensitive molecular component configured to activate or inhibit a second another molecular component at a second bioswitch temperature $Tbs_2$. In the multiplexed genetic circuit the first bioswitch temperature $Tbs_1$ is equal to one of the at least two different target temperatures of the target environment and the second bioswitch temperature $Tbs_2$ is equal to another one of the at least two different target temperatures of the target environment. In the multiplexed genetic circuit, the first another molecular component is different from the second another molecular component and the first bioswitch temperature $Tbs_1$ is different from the second bioswitch temperature Tbs$_2$. In some embodiments at least one of the temperature sensitive genetic molecular components comprises a coiled coil and/or globular temperature sensitive transcription factor herein described having a bioswitch temperature Tbs equal to Tbs$_1$, or Tbs$_2$.

In some of these embodiments, the thermal genetic circuits can comprise at least two circuit motifs to form a multiplexed genetic circuit in which at least two signals generated from the at least two circuit motifs are activated or emitted at two different temperatures and then combined into one signal upon their activation in a shared environment, e.g. a cell environment. One of the circuit motifs can comprise a first temperature sensitive transcriptional factor that activates at a first temperature Tbs1, while the other circuit motif can comprise a second temperature sensitive transcriptional factor that activates at a second temperature Tbs$_2$, the second temperature being different from the first temperature.

In the temperature sensitive multiplexed genetic circuit herein described, the first temperature at which the first temperature sensitive transcriptional factor activates can be a temperature Tbs1 selected between 20° C. and 39° C., or 32 to 39° C. or 41 to 43° C., or 45 to 80° C. and the second temperature at which the second temperature sensitive transcriptional factor activates can be a temperature Tbs$_2$ selected between 20° C. and 39° C., or 32 to 39° C. or 41 to 43° C., or 45 to 80° C.

For example, as shown in FIGS. 8a-d (Example 4), the multiplexed genetic circuit comprises a first circuit motif having TlpA36 variant as the thermal transcriptional bioswitch, pTlpA as the promoter and GFP as the reportable molecular component, the first circuit motif being activated at a temperature of 36° C. The multiplexed genetic circuit of FIGS. 8a-d further comprises a second circuit motif having TcI WT as the thermal transcriptional bioswitch, pR-pL as the promoter and RFP as the reportable molecular component, the second circuit motif being activated at a temperature higher than the activation temperature of the first bioswitch (about 40° C.). Thus, upon activation of both bioswitches (for example, at 42° C. or above), the medium shows both green and red fluorescence.

In some embodiments, a temperature sensitive bandpass filter can be designed to be operated in a target environment at least two target temperatures forming a target temperature range, The bandpass filter is configured to be operated within genetic circuit comprising one or more molecular components connected one to another by biochemical reactions according to a circuit design. The temperature sensitive bandpass filter comprises a first temperature sensitive genetic molecular components configured to activate a first another molecular component of the genetic circuit at a first bioswitch temperature Tbs1 and to inhibit the first another genetic molecular component at a second bioswitch temperature Tbs$_2$. The temperature sensitive bandpass filter further comprises a second temperature sensitive genetic molecular components configured to inhibit the first genetic molecular component and activate or inhibit a second another molecular component of the genetic circuit at the bioswitch temperature Tbs2.

In the temperature sensitive bandpass filter, the first bioswitch temperature Tbs1 is equal to one of the at least two different target temperatures of the target environment, the second bioswitch temperature Tbs$_2$ is equal to another one of the at least two different target temperatures of the target environment In the multiplexed genetic circuit, the first another molecular component is different from the second another molecular component and the first bioswitch temperature Tbs$_1$, is different from the second bioswitch temperature Tbs$_2$. In some embodiments at least one of the temperature sensitive genetic molecular components comprises a coiled coil and/or globular temperature sensitive transcription factor herein described having a bioswitch temperature Tbs equal to Tbs$_1$, and/or Tbs$_2$.

In some other embodiments, the thermal genetic circuits are designed to comprise at least two circuit motifs to form a thermal or temperature sensitive bandpass filter in which a first bioswitch of a first circuit motif activates at a first temperature Tbs 1 and deactivates at a second temperature Tbs 2 and at the second temperature Tbs 2 a second bioswitch of a second circuit motif activates another component and deactivates the first bioswitch. Consequently, the two signals generated from the two circuit motifs alternate within a certain temperature range formed by the at least two target temperatures.

In particular, the first circuit motif comprises at least one temperature sensitive transcriptional factor that activates at a first temperature Tbs 1 and deactivates at a second temperature Tbs 2 and the second circuit motif comprises at least one temperature sensitive transcriptional factor that activates at the second temperature Tbs$_2$, the first temperature being different from the second temperatures.

In some embodiments, the at least one temperature sensitive transcriptional factor of the first circuit motif activates at a first temperature Tbs 1 selected between 20° C. and 39° C., or 32 to 39° C. or 41 to 43° C., or 45 to 80° C. and deactivates at a second temperature Tbs 2 selected between 20° C. and 39° C. or 32 to 39° C. or 41 to 43° C., or 45 to 80° C. and the at least one temperature sensitive transcriptional factor of the second circuit motif activates at the second.

For example, as shown in FIG. 8e-h (Example 4), the thermal bandpass filter comprises a first circuit motif having TlpA WT as the thermal transcriptional bioswitch, pTlpA as the operator-promoter and GFP as the reportable molecular component, the first circuit motif being activated at a temperature of 44° C. The thermal bandpass filter further comprises a second circuit motif having TcI38 and the wild type cI repressor as the thermal transcriptional bioswitches, pR-pL as the operator-promoter and RFP as the reportable molecular component, the second circuit motif being activated at a temperature of 38° C. and deactivated at a temperature of 44° C. (see FIG. 8g).

In embodiments herein described, the thermal bioswitches integrated in multiplexed and/or bandpass thermal genetic circuits can comprise one or more coiled coil temperature sensitive transcriptional factor such as TlpA or variants thereof, one or more globular temperature sensitive transcriptional factors such as cI, TcI and variants thereof, and/or one or more other thermal transcriptional factors identifiable to a person of ordinary skill in the art which are orthogonal to one or more molecular components of the target environment and/or the circuits.

In particular, in several embodiments of thermal genetic circuits, the thermal transcriptional bioswitches used herein in the thermal genetic circuits are orthogonal to endogenous cellular circuits and compatible with other thermo-responsive components in the target cell environment. In several embodiments, the thermal transcriptional bioswitches used herein in combination in the thermal genetic circuits such as bandpass and/or multiplexed genetic circuits are orthogonal one with respect to the other.

Temperature sensitive bioswitches herein described can be included in one or more vectors and in particular expression vectors. The term "vector" indicates a molecule configured to be used as a vehicle to artificially carry foreign genetic material into a cell, where it can be replicated and/or expressed. An expression vector is configured to carry and express the material in a cell under appropriate conditions.

Vectors herein described can comprise a polynucleotide encoding for one or more coiled coil and/or globular temperature sensitive transcription factors herein described, under control of one or more regulatory sequence regions in a configuration allowing to express the temperature sensitive transcription factors encoded by the polynucleotide in presence of suitable cellular transcription and translation factors.

In some embodiments an expression vector can comprise one or more polynucleotides encoding one or more temperature sensitive transcription factors herein described under control of one or more regulatory sequences including promoter and/or enhancer regions in a configuration allowing regulation of expression of the one or more temperature sensitive dimer proteins encoded by the polynucleotide in presence of necessary cellular transcription and translation factors. The regulatory sequences such as promoter and/or enhancer regions can be arranged proximally and/or distally 5' and/or 3' to the one or more polynucleotides encoding for a temperature sensitive transcription factors herein described. The expression vector can also comprise additional regulatory elements such as ribosome binding sites, and transcription termination sequences. In some embodiments, the regulatory sequences of promoter and/or enhancer regions regulating expression of one or more polynucleotides encoding a temperature sensitive transcription factors comprise DNA regulatory region regulated by binding of one or more temperature sensitive transcription factors.

In some embodiment, one or more vectors in combination can further comprise a target DNA polynucleotide controlled by one or more temperature sensitive bioswitches herein described (herein also indicated as gene or target gene) and the related DNA regulatory regions. In particular one or more target genes can be comprised in a vector, which can be the same vector or a different vector from a vector encoding a polynucleotide encoding a temperature sensitive dimer protein. The one or more target genes are comprised in the vector in a configuration allowing regulation of expression of the one or more target genes in presence of a corresponding temperature sensitive bioswitch herein described as well as necessary cellular transcription and translation factors. The regulatory sequences such as promoter and/or enhancer regions can be arranged proximally and/or distally 5' and/or 3' to the one or more target genes and includes DNA regulatory region corresponding to e temperature sensitive transcription factors. In some embodiments, the vectors can comprise regulatory sequences of promoter and/or enhancer regions regulating expression of one or more polynucleotides encoding for non-thermally regulated molecular components which can be comprised in a genetic circuit.

In some embodiments, one or more vectors are described containing molecular components of any one of the thermal genetic circuits is described. The vector can be designed to convert a cell into a temperature-dependent cell wherein one or more biological properties are activated in a temperature sensitive manner by one or more temperature sensitive genetic circuit herein described. The vector can be a plasmid, a virus such as a bacteriophage, or a bacterium that is designed to deliver DNA to another bacterial species via conjugation.

In some embodiments, a DNA or RNA molecule containing one or more the thermal genetic circuits is described. The DNA or RNA molecule can be used to create the vectors described above or to transform bacterial cells.

In some embodiments, vectors can be used to create a temperature sensitive cell to be operated in a target environment at least two target temperatures. The temperature sensitive cell comprises a temperature sensitive genetic circuit herein described. In the temperature sensitive genetic circuit, at least one of the genetic molecular components is a temperature sensitive genetic molecular components, each having a bioswitch temperature $Tbs_C$ in the cell equal to at least one of the at least two target temperatures. In some embodiments at least one of the temperature sensitive genetic molecular components comprises a coiled coil and/or globular temperature sensitive transcription factor herein described having a bioswitch temperature Tbs equal to $Tbs_C$ In some embodiments, the thermal logic circuits with the integrated bioswitches herein described can be used in in vivo microbial therapy scenarios, including spatially precise activation using focused ultrasound, modulation of activity in response to a host fever, and self-destruction after fecal elimination to prevent environmental escape and provide a capability for coupling endogenous or applied thermal signals to cellular function in biomedical and industrial applications.

In some embodiments, a temperature-sensitive therapeutic cell is described. The temperature-responsive therapeutic cell comprises a temperature sensitive genetic circuit herein described comprising at least one temperature sensitive molecular component and at least one therapeutic molecular component and designed to provide a therapeutic output. In the genetic circuit of the therapeutic cell, the at least one temperature sensitive molecular components is configured to activate or inhibit the at least one therapeutic molecular component at a therapeutic bioswitch temperature $Tbs_T$ to provide the therapeutic output of the genetic circuit.

A therapeutic circuit output in the sense of the disclosure comprises expression of one or more therapeutic proteins that are secreted or displayed on the cell membrane. A therapeutic protein so expressed can interact under appropriate conditions with surrounding cells or molecules of the host in a way that alters the biological state of the host, leading to effects such as the death of certain host cells, change in the state of certain host cells (for example, immune cell activation or inactivation, stem cell differentiation or neuronal excitability increase or decrease), recruitment of certain host cells (such as immune cells). Examples of therapeutic genes include Cytokines to modulate the immune response, such as IL-10, IL-2, TNF, TGFbeta, Cell-killing proteins such as cytolysin, hemolysin, growth factors such as VEGF or BDNF. The system can control the expression of one or more genes assembled in series.

In some embodiments bioswitch temperature $Tbs_T$ is achieved in the temperature sensitive therapeutic cell in response to a thermal stimulus. In some embodiments, the thermal stimulus is selected from a host fever or external source of thermal energy such as focused ultrasound, infrared, magnetic particle hyperthermia. In some embodiments at least one of the temperature sensitive genetic molecular components comprises a coiled coil and/or globular temperature sensitive transcription factor herein described having a bioswitch temperature Tbs equal to $Tbs_T$.

The temperature-responsive therapeutic cells can comprise a plurality of bacterial cells such as *E. coli, Salmonella, Bacteroides, Lactobacillus*. The cells can be natural cells with desirable therapeutic properties such as ability to colonize the GI tract or home to and colonize a tumor, or they can be genetically modified cells that have been engineered for enhanced disease homing, proliferation, and additional properties identifiable by a skilled person.

In some embodiments, the temperature sensitive therapeutic cells can comprise a plurality of eukaryotic cells. In some embodiments, the eukaryotic cells are unicellular organisms. Exemplary unicellular eukaryotes comprise protozoa, such as ciliates such as *Paramecia, Stentors* and *Vorticella*, amoebas such as *Physarum* and *Entamoeba*, unicellular algae such as euglenophyta, chlorophyte, diatoms, dinoflagellates, unicellular fungi such as yeasts such as *Saccharomyces* and *candida* species. For example, in some embodiments, the temperature sensitive therapeutic cells comprise genetically modified yeast cells that are introduced into an individual to secrete a therapeutic substance in a temperature-regulated manner. In some embodiments, the temperature sensitive therapeutic cells are cells in or isolated from multicellular eukaryotic species. Multicellular eukaryotic species comprise mammalian species such as animals, plants, and multicellular fungi. In some embodiments, multicellular eukaryotes comprise species such as *Homo sapiens* and *Mus musculus*, for example, among others. In some embodiments, temperature sensitive therapeutic cells comprise stem cells, progenitor cells, induced pluripotent stem cells, and others identifiable by a skilled person. In some embodiments, temperature sensitive therapeutic cells comprise genetically engineered mammalian stem cells, for or example, genetically engineered stem cells that have been designed to secrete therapeutic substance after introduction into a host, such as a human.

In some embodiments, the temperature-responsive therapeutic cells can comprise a plurality of mammalian cells compatible with the target host, such as T-cells, hematopoietic stem cells, mesenchymal stem cells, neural precursor cells, macrophages, fibroblasts or cardiomyocytes.

The temperature sensitive therapeutic cells herein described can contain a thermal genetic circuit, which includes at least one therapeutic gene whose transcription is controlled by one or more transcription control elements that are regulated by temperature. These transcriptional control elements include at least one DNA sequence upstream of the therapeutic gene (e.g. an operator or promoter) and a thermal transcriptional bioswitch such as a temperature-dependent repressor protein that binds to this operator. The thermal transcription bioswitch or temperature-dependent repressor protein has the property that changes of temperature around a certain desired set-point (e.g. 40° C.) cause the protein to unbind from the corresponding DNA operator and allow the gene it regulates to be expressed. The unbinding of the repressor causes gene expression because it either reveals a promoter binding site of the DNA that was blocked by the repressor or because it prevents the bound repressor from stalling the RNA polymerase whose transcriptional activity is initiated upstream from the operator. The thermal transcription bioswitch can be mutated from natural repressors so that their threshold temperature is different from the natural threshold temperature.

In some embodiments, the temperature sensitive therapeutic circuit can be designed to include at least one temperature sensitive transcriptional factor activating at a therapeutic temperature bioswitch Tbs$_T$ between 32 to 45° C., in particular between 32° C. and 39° C., or between 32 to 36° C. or 36 to 39° C., or 39 to 41° C., or above 41 C possibly between 41 to 43° C., or 41 to 45° C.

Figure 6:
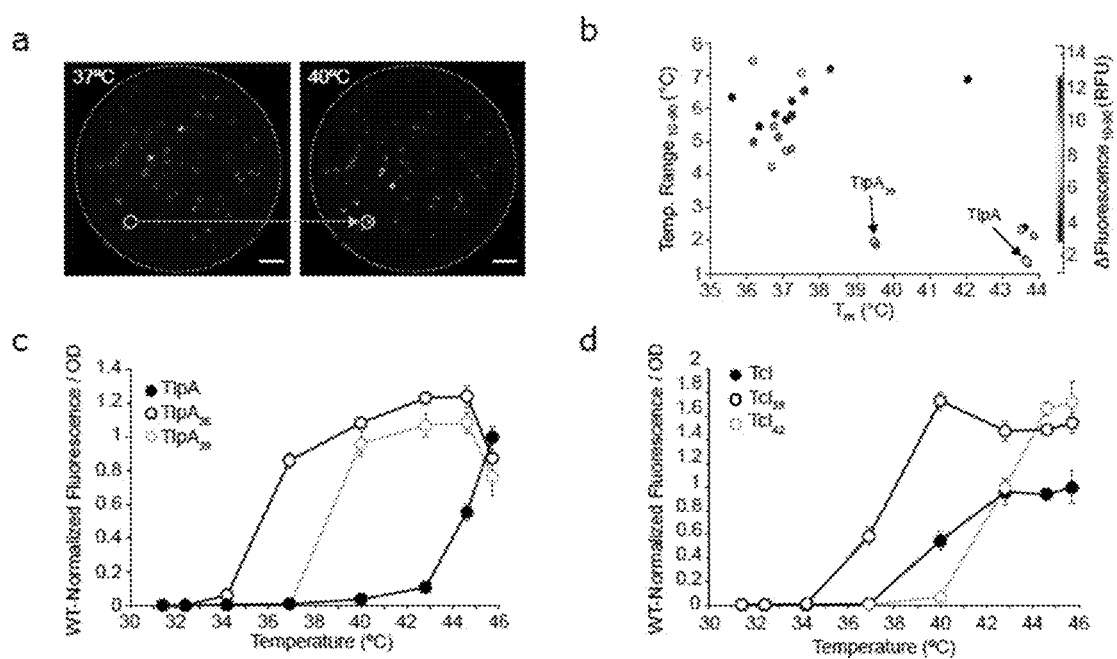
FIG. 6 shows exemplary results of tuning the transition temperature of thermal bioswitches.
Figure 9:
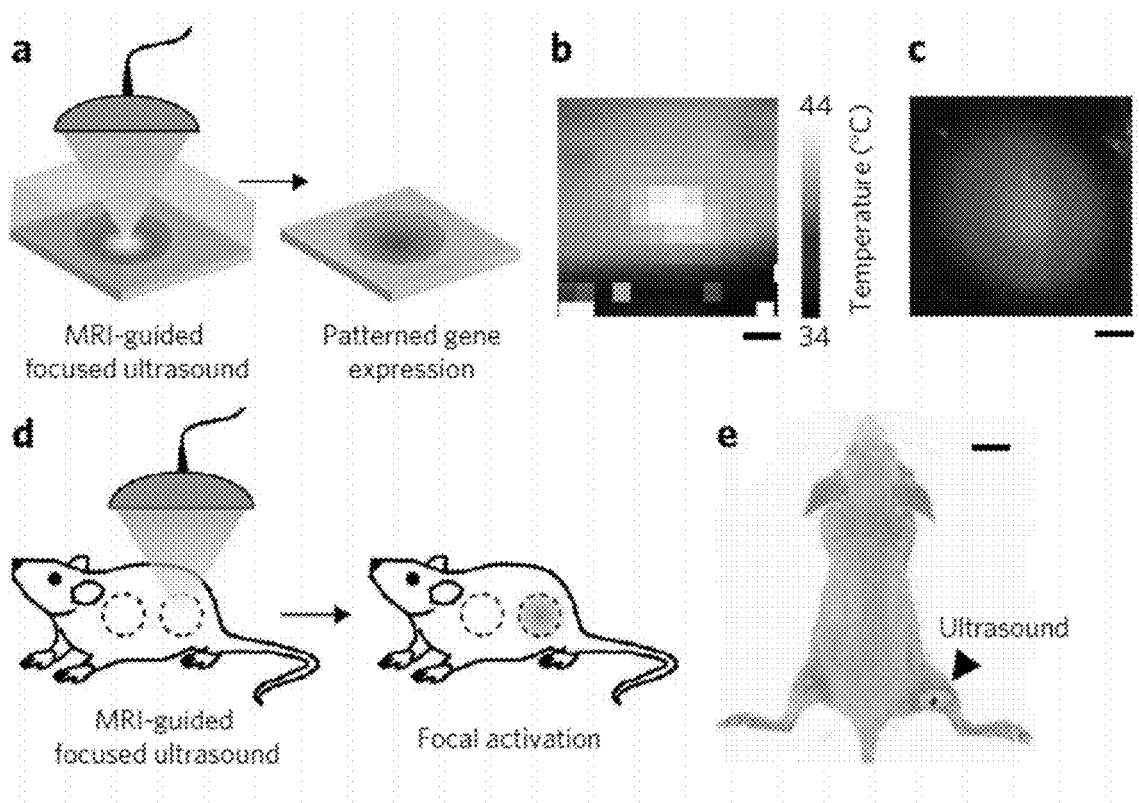
FIG. 9(c) shows an example of a fluorescent image of the region targeted by ultrasound depicted in FIG. 9(b), showing activation consistent with a bacterial construct expressing GFP under the control of TlpA$_{36}$ and RFP regulated by TcI, where the light grey spot in the middle corresponds to RFP expression at the focal point of ultrasound application (highest temperature in the thermal gradient) and the dark grey circle at the penumbra of the focused ultrasound (where temperature is lower) corresponds to GFP expression.
FIG. 9(d) shows an illustration of an example of an in vivo experiment, in which focused ultrasound is used to activate subcutaneously-injected bacteria transformed with a plasmid encoding a thermal bioswitch regulating GFP expression, at a specific anatomical site, for example subcutaneously into hindlimbs (shown by circles with dashed lines), where ultrasound application results in GFP expression (dashed circle filled in with grey).
FIG. 9(e) shows an exemplary image of a thresholded fluorescence map of a mouse injected subcutaneously in both left and right hindlimbs with E. coli expressing GFP under the control of TlpA$_3$, following ultrasound activation at only the right hindlimb. Focused ultrasound at the site indicated with a black arrowhead results in highest fluorescence level in the center of the focused ultrasound application (dark grey spot in center), surrounded by a light grey circle at the penumbra of focused ultrasound application. Scale bars 2 mm (FIG. 9b and FIG. 9c) and 1 cm (FIG. 9e).
Figure 10:
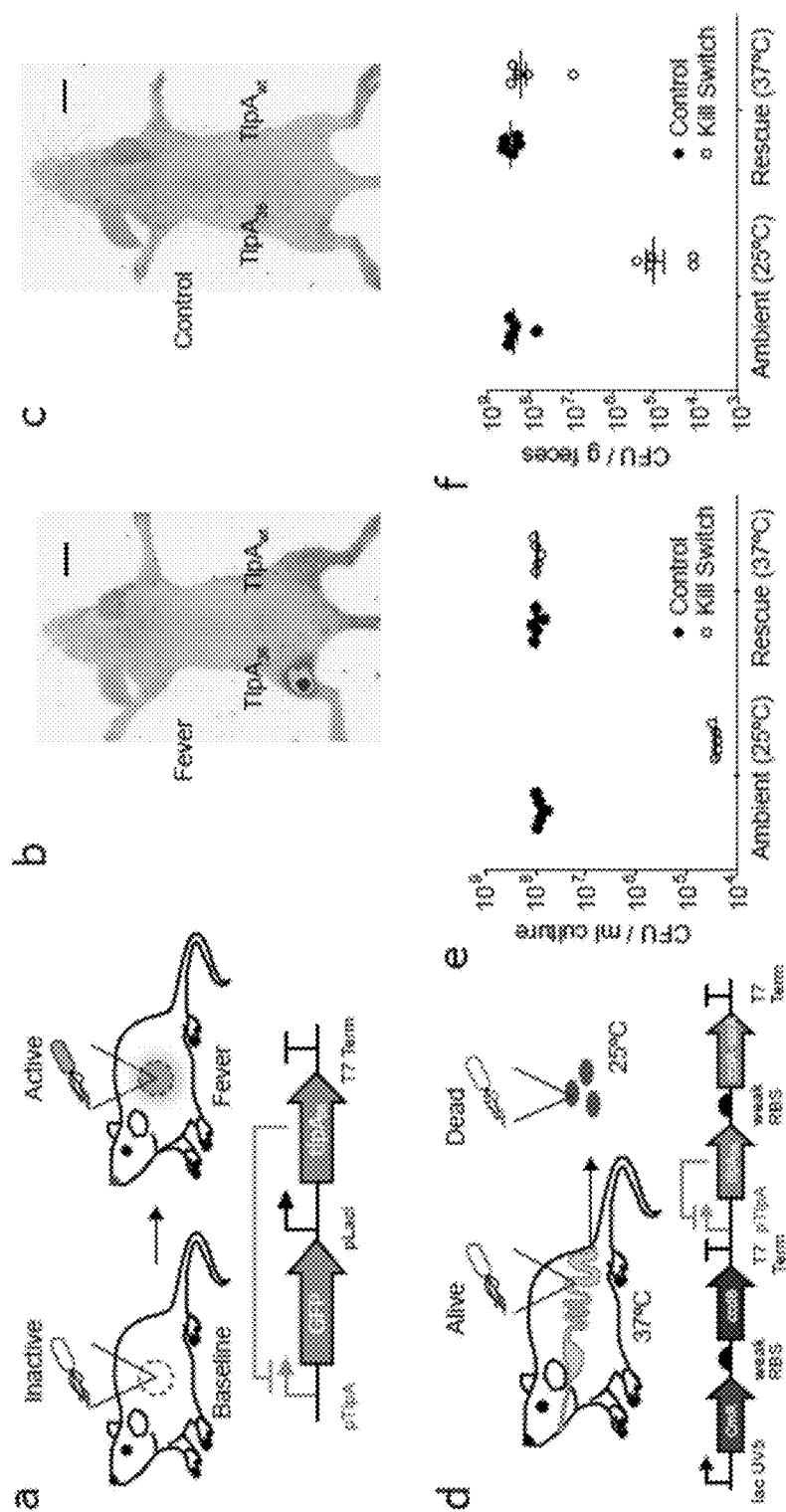
FIG. 10 shows examples of programmed thermal bioswitch responses to mammalian host temperature.

In some embodiments, the temperature-responsive therapeutic cells can be designed to activate the expression of their therapeutic gene in response to a thermal stimulus, such as ingestion into a host (set point around 36° C.), a host fever (set point around 38.5° C.) or heating using an external source of energy such as focused ultrasound, infrared, magnetic particle hyperthermia (see FIGS. 6c and 6d; FIG. 9; FIGS. 10a-c).

Examples of therapeutic genes include Cytokines to modulate the immune response, such as IL-10, IL-2, TNF, TGFbeta, Cell-killing proteins such as cytolysin, hemolysin, growth factors such as VEGF or BDNF. The system can control the expression of one or more genes assembled in series.

In some embodiments of temperature-responsive therapeutic cells, rather than directly controlling the therapeutic genes, the thermal bioswitch can control the expression of another protein that controls the expression of those genes. For example, the thermal bioswitch controls the expression of a transcription factor that acts on a promoter that drives the expression of therapeutic genes. By selecting this promoter to be stronger or weaker, the magnitude of thermally induced expression of therapeutic genes is controlled.

Alternatively, the thermal bioswitch can control the expression of a recombinase (e.g. FimB, FimE, TP091, Bxb1 or phiC31), which in turn acts on a DNA sequence in which the therapeutic genes are configured such that the thermally triggered expression of recombinase causes them to be permanently switched on. This allows the therapeutic cell to have a permanent response to a single thermal trigger. Conditional expression of a second recombinase (e.g. under the control of a chemical inducer) can be used to reverse the action of the temperature-induced recombinase.

Alternatively, the thermal bioswitch can control the expression of a genome editing protein or guide RNA, such as Cas9 or one its derivatives. The Cas9 can be active as a DNA-cutting enzyme or could have one of the other functions engineered for it, such as acting as a repressor or transcriptional activator (e.g. dCas9).

In some embodiments, in addition to placing the therapeutic genes, transcription factors or recombinases downstream of the temperature-dependent repressor's operator sequence, we also have a copy of the temperature-sensitive repressor itself. This creates a negative feedback loop such that if there is any leaky expression due to the low concentration of repressor protein, it will lead to a buildup in the concentration of that protein. This is implemented in our examples (e.g. FIG. 2a and FIG. 8f) where the expression of the temperature-sensitive repressor is driven by both, its own operator and a constitutively active promoter (pLacI).

In some embodiments, genes downstream of the temperature-dependent repressor's operator sequence include a reportable molecular component gene designed to signal the activation of the circuit. This reporter gene can be a fluorescent protein, a luminescent protein or a protein (or group of proteins) detectable by magnetic resonance imaging or ultrasound. The reporter gene can also be a protein that results in local accumulation of a radiation emitting compound detectable by positron emission tomography or single photon emission computed tomography.

In some embodiments, the operator is bi-directional (e.g. TlpA, see FIG. 4, c-e). and there are two genes placed under its control by putting one in one orientation and the other in the other orientation.

In some embodiments, the operator is a promoter that is activated when the temperature-dependent repressor is bound to it, rather than when it unbinds. The example is TcI with the pRM promoter [46].

The temperature-responsive therapeutic cells herein described can contain these genetic circuits either in their genome or on a plasmid. The cells exhibit 100-fold difference in gene expression between the off state and on state and achieve 10-fold switching over a temperature range smaller than 5° C.

In some embodiments, temperature-responsive biosynthetic cells are described. The temperature-responsive biosynthetic cells comprise a plurality of bacterial cells such as E. coli or B. subtilis that a designed for use in a biosynthetic pathway, e.g. in a bioreactor. Examples include cells engineered to catalyze a certain organic chemical reaction, produce a biofuel, take up a contaminant for bioremediation, etc.

The temperature-responsive biosynthetic cell is designed to activate the expression of its therapeutic gene in response to a change in temperature in the biosynthetic reaction apparatus, which is controlled by the reactor's operator (see FIGS. 6c and 6d). Examples of biosynthetic genes include enzyme in a biosynthetic pathway and regulatory protein that controls the activity of one or more enzymes. The system can be designed to control the expression of one gene or more genes assembled in series.

In some embodiments, rather than directly controlling the therapeutic genes, the system can control the expression of another protein that controls the expression of those genes. For example, the thermal bioswitch is designed to control the expression of a transcription factor that acts on a promoter that drives the expression of therapeutic genes. By selecting this promoter to be stronger or weaker, the magnitude of thermally induced expression of biosynthetic genes is controlled.

Alternatively, the thermal bioswitch can control the expression of a recombinase, which in turn acts on a DNA sequence in which the biosynthetic genes are configured such that the thermally triggered expression of recombinase causes them to be permanently switched on. This allows the biosynthetic cell to have a permanent response to a single thermal trigger.

In some embodiments, in addition to placing the biosynthetic genes, transcription factors or recombinases downstream of the temperature-dependent repressor's operator sequence, a circuit can be designed also having a copy of the temperature-sensitive repressor itself. This creates a negative feedback loop such that if there is any leaky expression due to the low concentration of repressor protein, it will lead to a buildup in the concentration of that protein. This is implemented in our examples (e.g. FIG. 2a and FIG. 8f) where the expression of the temperature-sensitive repressor is driven by both, its own operator and a constitutively active (i.e. always on) promoter (pLacI).

In some embodiments, the temperature-responsive biosynthetic cells herein described allow the biosynthetic activity of a cell to be modified conveniently by changing the temperature of the bioreactor. This can be used, for example, to temporally control production, wherein one biosynthetic function operates for a short period to build up the appropriate chemical intermediate, then a second function is turned on to convert that intermediate into the next intermediate or product in the synthetic pathway. Particular embodiments can be applied in cases where the two biosynthetic functions have cross-reactivity, preventing them from effectively running at the same time.

In some embodiments, temperature-inactivated therapeutic cells are described. Similar to the temperature-responsive therapeutic cells herein described, in the temperature-inactivated therapeutic cells, instead of being directly regulated by the thermal transcriptional repressor, the therapeutic gene is controlled by another repressor (not temperature dependent), which is, in turn controlled by the engineered temperature-dependent repressor. In this configuration, temperatures above the set-point of the thermal repressor will cause expression of the temperature-independent repressor, which will cause shut-down of the expression of the therapeutic gene.

For example, as shown in FIG. 8e-g, TlpA controls the expression of a temperature-insensitive variant of the lambda repressor, which in turn controls the expression of a fluorescent protein. This therapeutic cell is designed to turn off its therapeutic activity in response to a thermal stimulus such as a fever, which could be an indicator of undesired consequences for the host. Another example is applications in a topical cell therapy, which becomes active at the skin (set point 35° C.).

In some embodiments, instead of controlling the expression of a temperature-independent repressor, the thermal switches can be designed to control the expression of a recombinase, as described above. In this case, the therapeutic genes are flanked by recombinase sites in such a manner that the consequence of recombinase activity is to permanently disable their expression (e.g. by deleting them).

In some embodiments of the temperature-responsive therapeutic cells, the cells are designed to express therapeutic genes within a specified temperature range (FIG. 8e-g). The thermal genetic circuit combines two orthogonal temperature-dependent transcriptional repressors, such as TlpA and TcI, as well as a temperature-independent version of the repressor that has a lower-temperature set point (e.g. cI in addition to TcI). The therapeutic gene is preceded by an operator that is repressed by both the lower-temperature set-point temperature-sensitive repressor and its temperature-independent analog. The temperature-independent repressor is expressed under control of the higher-temperature transcriptional repressor.

As a result of this arrangement, there are three temperature dependent therapeutic states. For example, if the lower-temperature repressor has a set-point of X° C. and the higher-temperature repressor has a set-point of Y° C., such that X<Y, then the regimes are: i) temperature <X° C.: therapeutic genes are not expressed; ii) temperature >X° C. and <Y ° C.; therapeutic genes are expressed; and iii) temperature >Y° C.; therapeutic genes are not expressed. In this configuration, the therapeutic cells become active when inside the host (e.g. X=36) and inactivated in response to a fever (e.g. Y=38.5).

Alternatively, the two temperature-dependent repressors can be used to control the expression of two recombinases that switch the expression of a given gene stably on and off.

In some embodiments of the temperature-responsive therapeutic cells, the therapeutic cells are designed to express two different therapeutic genes in response to two different temperatures. In this case, the cell contains to different therapeutic genes under the independent control of two orthogonal temperature-dependent transcriptional repressors, each with a distinct thermal set-point (e.g. FIG. 8a-c). In this configuration, the therapeutic cells will be at the on-state when inside the host (e.g. set-point of 36° C.) and become activated in response to a remote thermal signal such as focused ultrasound.

In some embodiments, a genetic circuit can be designed to be included in a temperature sensitive inactivable cell comprising a temperature sensitive genetic circuit herein described in which at least one temperature sensitive molecular component is configured to activate or inhibit at least one killer molecular component at an inactivating bioswitch temperature $Tbs_I$ In some embodiments the inactivating bioswitch temperature $Tbs_I$ is achieved in the temperature sensitive therapeutic cell in response to a decrease in the cell temperature associated with a spatial translocation of the temperature sensitive inactivable cell. In some embodiments at least one of the temperature sensitive genetic molecular components comprises a coiled coil and/or globular temperature sensitive transcription factor herein described having a bioswitch temperature Tbs equal to $Tbs_I$ In some embodiments, the temperature sensitive killer circuit can be designed to include at least one temperature sensitive transcriptional factor activating at an inactivating temperature bioswitch $Tbs_I$ between 32 to 45° C., in particular between 32° C. and 39° C., or between 32 to 36° C. or 36 to 39° C., or 39 to 41° C., or above 41 C possibly between 41 to 43° C., or 41 to 45° C.

In some those embodiments the output of the activated circuit can be the expression of a protein that is toxic to the cell containing the circuit, resulting in cell death, being unable to synthesize RNA or proteins or failing to divide. Example self-toxic output proteins include CcdB and PezT. Alternatively, the output of the circuit could be shut-down of the expression of an antitoxin that is required to prevent the activity of an always-expressed toxin.

In particular in some of these embodiments, to enact cellular suicide when the temperature goes above a certain set-point, the temperature-dependent repressor controls the expression of a suicide toxin such as CcdB. To enact cellular suicide when the temperature goes below a certain set-point, the toxin from a toxin-antitoxin pair (e.g. CcdB) is expressed constitutively, and the anti-toxin (e.g. CcdA) is expressed under the control of a temperature-dependent repressor. When the temperature drops below the set-point, expression of the anti-toxin stops and the cell dies.

In some embodiments, the output of the killer circuit can be modulated to in accordance with the characteristics of the target environment and other factors related to space and time of desired effects as well as features of the cell as will be understood by a skilled person. In particular, the levels of toxin and antitoxin expression can be adjusted for this circuit to function properly, for example, by fusing a protein degradation tag to the antitoxin to accelerate cell death at nonpermissive temperatures.

In some of these embodiments, the temperature inactivable cells are also therapeutic cells and in particular, temperature sensitive therapeutic cells herein described that can be designed to destroy themselves in the case of a fever (e.g. at set point 38.5° C.) or upon entry into the host from being on the skin (set-point 35° C.). In some other embodiments, the therapeutic cells can be designed to destroy themselves after leaving their host due to defecation, vomiting, cough, etc. The set-point can be 36° C.

In particular, to prevent cells from surviving by mutating genetic components of the circuit, the therapeutic cells can be designed to contain multiple independent toxin (and, where appropriate, anti-toxin) systems regulated by one or more temperature-dependent transcriptional repressors. This redundancy exponentially decreases the likelihood of escape.

In some embodiments one or more temperature sensitive transcription factors, and in particular one or more coiled coil and/or globular temperature sensitive transcription factors, vectors, genetic circuit and/or temperature sensitive cells herein described together with a suitable vehicle.

The term "vehicle" as used herein indicates any of various media acting usually as solvents, carriers, binders or diluents for the one or more coiled coil and/or globular temperature sensitive transcription factors, vectors, genetic circuit and/or temperature sensitive cells herein described that are comprised in the composition as an active ingredient. In particular, the composition including the one or more coiled coil and/or globular temperature sensitive transcription factors, vectors, genetic circuit and/or temperature sensitive cells herein described can be used in one of the methods or systems herein described In some embodiments, one or more temperature sensitive transcription factors, and in particular one or more coiled coil and/or globular temperature sensitive transcription factors, vectors, genetic circuit and/or temperature sensitive cells herein described and related compositions can be used in a method to control a biological process in an individual or another target environment. The method comprises administering to the individual, or contacting the another target environment with, one or more temperature sensitive cells herein described comprising a temperature sensitive genetic circuit herein described. In the method the temperature sensitive genetic circuit is configured to provide an output interfering with the biological process in the individual at a set target temperature between 34° C. and 44° C.

In some embodiments, the set target temperature can be selected from 34 to 41<33° C. (ambient environment), 33-34° C. (including skin temperature) 34-36° C. (including hypothermic core temperature), 36-38° C. (including human physiological temperature), 38-40° C. (including mild fever in humans, 40° C.-42° C. (including severe fever in humans), 39° C.-45° C. (including applied hyperthermia in humans (e.g. HIFU))

In some embodiments, one or more temperature sensitive transcription factors, and in particular one or more coiled coil and/or globular temperature sensitive transcription factors, vectors, genetic circuit and/or temperature sensitive cells herein described and related compositions can be used in a method to treat or prevent a condition in an individual. The method comprises administering to the individual one or more therapeutic temperature sensitive cells herein described comprising a temperature sensitive genetic circuit herein described. In the method the temperature sensitive genetic circuit is configured to provide a therapeutic output in the individual at a set target temperature between 34° C. and 44° C.

The term "treatment" as used herein indicates any activity that is part of a medical care for, or deals with, a condition, medically or surgically. The terms "treating" and "treatment" refer to reduction in severity and/or frequency of symptoms, elimination of symptoms and/or underlying cause, prevention of the occurrence of symptoms and/or their underlying cause, and improvement or remediation of damage. Thus, for example, "treating" a patient involves prevention of a symptom or adverse physiological event in a susceptible individual, as well as modulation and/or amelioration of the status of a clinically symptomatic individual by inhibiting or causing regression of a disorder or disease.

The term "prevention" as used herein with reference to a condition indicates any activity which reduces the burden of mortality or morbidity from the condition in an individual. This takes place at primary, secondary and tertiary prevention levels, wherein: a) primary prevention avoids the development of a disease; b) secondary prevention activities are aimed at early disease treatment, thereby increasing opportunities for interventions to prevent progression of the disease and emergence of symptoms; and c) tertiary prevention reduces the negative impact of an already established disease by restoring function and reducing disease-related complications.

The term "condition" indicates a physical status of the body of an individual (as a whole or as one or more of its parts e.g., body systems), that does not conform to a standard physical status associated with a state of complete physical, mental and social well-being for the individual. Conditions herein described comprise disorders and diseases wherein the term "disorder" indicates a condition of the living individual that is associated to a functional abnormality of the body or of any of its parts, and the term "disease" indicates a condition of the living individual that impairs normal functioning of the body or of any of its parts and is typically manifested by distinguishing signs and symptoms in an individual.

The term "individual" or "subject" or "patient" as used herein in the context of treatment includes a single animal and in particular higher animals and in particular vertebrates such as mammals and in particular human beings.

In some embodiments, a method of treating a disease is described. The method comprises administering the therapeutic cells described above to a subject, allowing for these cells to distribute within the body, and treating the subject with a source of targeted thermal energy for at least 1 minute that leads to activation of a thermal bioswitch. The thermal energy can be in the form of focused ultrasound, radiofrequency magnetic hyperthermia, microwave, infrared or contact heating (see Example 4 and FIG. 9d). The methods herein described can be used to target the therapeutic activity of the cells to a specific location within the body, even if the cells are distributed more widely than that one location.

In some embodiments, one or more temperature sensitive transcription factors, and in particular one or more coiled coil and/or globular temperature sensitive transcription factors, vectors, genetic circuit and/or temperature sensitive cells herein described and related compositions can be used in a method to control cell viability in a temperature sensitive manner. The method comprises providing a temperature sensitive cell comprising one or more temperature sensitive genetic circuits herein described comprising at least one temperature sensitive molecular component configured to activate at least one killer molecular component at an inactivating bioswitch temperature $Tbs_I$. The method also comprises applying to the temperature sensitive cell the inactivating bioswitch temperature $Tbs_I$ for time and under condition to allow activation of the at least one killer components by the at least one temperature sensitive molecular component and to result in death of the temperature sensitive cell.

In some embodiments, the deposition of thermal energy to activate the thermal bioswitch is guided spatially by magnetic resonance imaging (MRI). Additionally, MRI can be used to monitor the temperature of the target region and adjust the energy source to achieve the desired local temperature (FIG. 9b).

Further details concerning the thermal bioswitches, and related thermal genetic circuits, therapeutic cells, systems and methods of the present disclosure will become more apparent hereinafter from the following detailed disclosure of examples by way of illustration only with reference to an experimental section.

Examples

The tunable thermal bioswitches and related systems and methods herein disclosed are further illustrated in the following examples, which are provided by way of illustration and are not intended to be limiting.

In particular, the following examples illustrate exemplary methods and protocols for preparing sets of polynucleotides and polypeptides, testing and characterizing these sets of polynucleotides and polypeptides, building genetic circuits, and testing genetic circuits in vivo and in vitro. A person skilled in the art will appreciate the applicability and the necessary modifications to adapt the features described in detail in the present section, to additional tunable thermal bioswitches, genetic circuits and therapeutic cells and related methods and systems according to embodiments of the present disclosure.

Plasmid Construction and Molecular Biology.

All constructs were made via restriction cloning, KLD mutagenesis, or Gibson Assembly using enzymes from New England Biolabs. All plasmids and their sources of genetic material are described in Table 1. All constructs were cloned in Mach1 *E. coli* (Thermo Fisher) and the sequence-validated plasmids were assayed in NEB 103 *E. coli* (NEB). Fluorescent reporters referred to in the text as GFP and RFP are mWasabi and mCherry, respectively[47, 48]. All plasmids were constructed using the pETDuet-1 backbone (EMD Biosciences) with the relevant thermal biosensor elements replacing multiple cloning sites 1 and 2.

TABLE 1

Genetic constructs

| Plasmid | Transcriptional Regulator(s) | Output Gene Product(s) |
| --- | --- | --- |
| pTlpA-Wasabi | TlpA | mWasabi |
| pTlpA-Wasabi-NF | TlpA | Nonfluorescent mWasabi (S71T, G73A) |
| pTcI-Wasabi | TcI (cI852 Repressor, cI A67T) | mWasabi |
| pLacI241-Wasabi | LacI A241T (mutation made in pETDuet-1 LacI) | mWasabi |
| pLacI265-Wasabi | LacI G265D (mutation made in pETDuet-1 LacI) | mWasabi |
| pTetR89-Wasabi | TetR A89D | mWasabi |
| pTetR193-Wasabi | TetR I193N | mWasabi |
| pLon-Wasasbi | Lon Promoter (GenBank CP009072) | mWasabi |
| pRpoH-Wasabi | RpoH Promoter (GenBank CP009072) | mWasabi |
| pClp-Wasabi | ClpP-ClpX Promoter (Genbank CP009072) | mWasabi |
| pHtpG-Wasabi | HtpG Promoter (Genbank CP009072) | mWasabi |
| pDnaK-Wasabi | DnaK Promoter (Genbank CP009072) | mWasabi |

TABLE 1-continued

Genetic constructs

| Plasmid | Transcriptional Regulator(s) | Output Gene Product(s) |
|---|---|---|
| pGrpE-Wasabi | GrpE Promoter (Genbank CP009072) | mWasabi |
| pLacIq-Wasabi | LacIq Promoter | mWasabi |
| pTlpA$_{SP}$-Wasabi | TlpA Promoter with putative Pribnow box scrambled | mWasabi |
| pTlpA$_{Reverse}$-Wasabi | TlpA Promoter as reverse complement | mWasabi |
| pTlpA$_{36}$-Wasabi | TlpA$_{36}$ | mWasabi |
| pTlpA$_{39}$-Wasabi | TlpA$_{39}$ | mWasabi |
| pTcI$_{38}$-Wasabi | TcI$_{38}$ | mWasabi |
| pTcI$_{42}$-Wasabi | TcI$_{42}$ | mWasabi |
| pCali2 | TlpA$_{36}$, TcI | mWasabi, mCherry |
| pThermeleon | TcI, TlpA, cI$_{wt}$ (under control of TlpA) | mWasabi, mCherry |
| pKillswitch | TlpA$_{36}$ | CcdA with SsrA degradation tag |

Sources of genetic elements: TlpA: B. Finlay, Univ. British Columbia; mWasabi: F. Arnold, Caltech; mCherry: S. Qi, Stanford; CcdB: pLenti X1 Zeo DEST plasmid (Addgene #17299); TetR: pENTR1A plasmid (Addgene #22265); all other elements: Gblock synthesis (IDT).

TABLE 2

Mutations in variants of TlpA and TcI

| Construct | Nonsynonymous Mutations | Synonymous Mutations |
|---|---|---|
| TlpA$_{36}$ | P60L, D135V, K187R, K202I, L208Q | |
| TlpA$_{39}$ | D135V, A217V, L236F | |
| TcI$_{38}$ | M1V, L65S, K68R, F115L, D126G, D188G | A50 (GCT -> GCC), E128 (GAG -> GAA), R129 (AGA -> AGG), T152 (ACA -> ACC), L185 (CTT -> CTC) |
| TcI$_{42}$ | K6N, S33T, Y61H, L119P, F122C | L51 (TTA -> CTA) |

Thermal Regulation Assay.

2 mL cultures of 2×YT media with 100 µg/mL ampicillin were inoculated with a single colony per culture and grown at 30° C., 250 rpm for 20 hours. After dilution to OD$_{600}$=0.1 in LB (Sigma) with 100 µg/mL ampicillin, the cells were propagated at 30° C., 250 rpm for 1.5 hours, after which OD$_{600}$ was measured using a Nanodrop 2000c (Thermo Scientific) in cuvette mode every 10 minutes. At OD$_{600}$=0.25, the cultures were dispensed in 25 µL aliquots into 8 well PCR strips with optically transparent caps (Bio-Rad) using a multichannel pipette and placed into a spatial temperature gradient formed by a Bio-Rad C1000 Touch thermocycler with the lid set to 50° C. The temperature in each thermocycler well was verified using a TEF-30-T thermocouple (J-KEM Scientific) immersed in 25 µL of pure water within a PCR tube. After the prescribed thermal stimulus, PCR strips were removed, vortexed, spun down on a tabletop centrifuge and the fluorescence was measured using a Stratagene MX3005p qPCR (Agilent). Immediately after measurement, the cultures were diluted with 75 µL LB/Amp and mixed, after which 90 µL of culture was transferred into 96 well plates (Costar black/clear bottom) for measurement of OD$_{600}$ using a SpectraMax M5 plate reader (Molecular Devices). For studies of gene expression as a function of thermal induction time (FIG. 2, d-f), samples were returned to incubation at 30° C. after their indicated thermal induction periods such that the total experimental duration was 24 hours. Fluorescence measurements were made at the end of this period. Gene expression (E) was determined according to Equation 1:

$$E = \frac{F_{sample} - F_{blank}}{OD_{sample} - OD_{blank}} - \frac{F_{background} - F_{blank}}{OD_{background} - OD_{blank}} \quad (1)$$

Here, F is the raw fluorescence of the given sample and OD is the OD of the given sample at 600 nm. Raw OD measurements for all experiments are provided in FIG. 1. As expected, bacterial growth is highest in the physiological range of 35° C. to 39° C. The value of blank fluorescence was determined as the average of all 96 wells in a qPCR plate filled with 25 µL LB. Blank OD was taken as the y-intercept of a standard curve of 90 µL non-fluorescent E. coli cultures whose OD$_{600}$ values were determined by cuvette measurements in a Nanodrop 2000c spectrophotometer (96 samples total). Background fluorescence was measured from a non-fluorescent construct derived by mutating the chromophore of mWasabi [49] in the pTlpA-Wasabi plasmid (pTlpA-Wasabi-NF). Fluorescence measurements for the thermal expression landscapes of TlpA and TcI were performed using the plate reader due to signal saturation of the qPCR at the 24 hour time point (Sample N=3; Background N=2 for each time point and temperature). Errors from background measurements were propagated by addition in quadrature. Errors from blank measurements were negligible relative to sample-to-sample variation (relative standard deviation <2%) and were omitted from the calculation.

Colony Screening for TlpA Tuning.

Error-prone PCR was performed on pTlpA-Wasabi (Stratagene GeneMorph II kit) and on pTcI-Wasabi (NEB Taq Polymerase/0.2 mM MnCl$_2$) and the PCR products were inserted into the parent constructs using Gibson Assembly. The resulting libraries were transformed into NEB 10β E. coli and plated on LB Agar. Following overnight incubation at 30° C. and the appearance of colonies, a Replica-Plating Tool (VWR 25395-380) was used to replicate each seed plate into two receiver plates. One receiver plate was grown overnight at the desired repressed temperature, and the other at the intended activation temperature. Upon the appearance of visible colonies, plates were imaged in a Bio-Rad Chemi-Doc MP imager using blue epifluorescent illumination and the 530/28 nm emission filter. Images were examined manually for colonies that appeared dark or invisible on the "off plate" but showed bright fluorescence on the "on plate".

Approximately 10³ colonies were screened per library. These colonies were picked and subjected to the liquid culture thermal activation assay described above, whereupon their thermal induction profile was compared to that of their parent plasmid. Variants that demonstrated sharp switching and large dynamic range between the desired new transition temperatures were sequenced, re-transformed, and assayed using a higher number of replicates.

In Vitro Toxin-Antitoxin Assays.

NEB 10β cells were transformed with the thermally regulated toxin-antitoxin plasmid and allowed to grow at 37° C. overnight. Because reversion of plasmids carrying toxic genes such as CcdB is known to be a common phenomenon, we used a replica plate screen to isolate colonies that maintained a functional thermal kill switch after transformation. To this end, we replica plated the original transformation into two new plates, one incubated at 25° C. and the other maintained at 37° C. Colonies that grew at the permissive temperature of 37° C. and not at 25° C. were used in downstream in vitro or in vivo experiments. For in vitro experiments, the selected colonies were grown in 2×YT media with 100 μg/mL ampicillin at 37° C. with shaking until $OD_{600}$ of 0.6 whereupon they were diluted and plated onto LB agar plates. The plates were incubated overnight at either 25° C. or 37° C., after which colony forming units (CFU) were counted.

Focused Ultrasound.

MRI-guided focused ultrasound treatment was performed using a 16-channel ultrasound generator, motorized MRI-compatible transducer positioning system and an annular array transducer operating at 1.5 MHz (Image Guided Therapy, Pessac, France). Targeting and real-time imaging was performed using a Bruker Biospec/Avance 7T MRI system with RF excitation delivered by a 7.2 cm diameter volume coil and detection via a 3 cm diameter surface coil. Temperature monitoring was performed using a continuously applied Fast Low Angle Shot sequence with a $T_R$ of 75 ms and $T_E$ of 2.5 ms, matrix size of 32×32, and varying FOVs as listed below. Phase images were processed in real time using ThermoGuide software (Image Guided Therapy) and temperature was calculated from the per-pixel phase accumulation due to a decrease in proton precession frequency of 0.01 ppm/° C. For in vitro heating, 100 μL of a saturated NEB 10β culture expressing the temperature-inducible reporter circuit was plated overnight at 30° C. and incubated for approximately 12 hours to form a lawn on a plate containing 0.24% w/v LB (Sigma) and 0.32% w/v Bacto Agar (BD). An approximately 3 cm×3 cm square of agar was excised from the plate and placed, with the bacterial side facing up, onto a comparably sized pad of 1 cm thick extra firm tofu (O Organics) coated with SCAN ultrasound gel (Parker Laboratories) to exclude air at the interface. A 1 cm high plastic washer made by drilling through the lid of a VWR 35 mm plastic tissue culture dish was placed onto the bacteria and the assembly was inverted and placed onto the surface coil such that the bacterial lawn, facing down, was supported by the washer. The ultrasound transducer was positioned above the assembly, in contact with the tofu through another thin layer of ultrasound gel. To provide a reference to compensate for global phase drift during the experiment, a second piece of tofu was placed within the field of view but spatially separated by a 1 cm air gap from the object under insonation. A fiber optic thermometer (Neoptix TI) was inserted into the reference tofu, and the difference between the MRI-derived reference temperature and thermometer-reported temperature was accounted for at the site of insonation when calculating the true focal heating. Ultrasound was applied with the focus aimed at the tofu immediately adjacent to the agar layer with manual control of power level and duty cycle so as to maintain a temperature of 41.5-43° C. for 45 minutes. Imaging was performed as described above with a matrix size of 5.39×5.05 cm and a slice thickness of 2 mm. The plate was subsequently returned to 30° C. for 5 hours and imaged using a Bio-Rad ChemiDoc MP imager with blue epi illumination and a 530/28 nm emission filter (mWasabi) and also green epi illumination and a 605/50 nm filter (mCherry).

Animal Procedures.

All animal procedures were performed under a protocol approved by the California Institute of Technology Institutional Animal Care and Use Committee (IACUC). 9-week old BALB/c female mice and 4-week old NU/J 2019 female mice were purchased from Jackson Laboratory (JAX); 4-week old SCID/SHC female mice were purchased from Charles River. For in vivo ultrasound actuation, E. coli expressing the pTlpA36-Wasabi plasmid were grown to OD 0.6, pelleted, and resuspended to OD 24. A 100 μL bolus was injected subcutaneously into both hindlimbs of a nude mouse (SCID or NU/J2019). Mice were anaesthetized using a 2% isoflurane-air mixture and placed on a dedicated animal bed with the surface coil positioned below the target limb of the mouse. Anesthesia was maintained over the course of the ultrasound procedure using 1-1.5% isoflurane. Respiration rate was maintained at 20-30 breaths per minute and temperature and respiration rate were continuously monitored using a pressure pad (Biopac Systems) and a fiber optic rectal thermometer (Neoptix). The target limb was thermally activated by elevating the temperature to 41° C. and maintaining the elevated temperature for 45 min to 1 hour. Temperature monitoring and adjustment was performed as described above for in vitro experiments. Following ultrasound treatment, the mouse was returned to its cage for four hours, anaesthetized, and imaged using a Bio-Rad ChemiDoc MP imager with blue epi illumination and the 530/28 nm emission filter (mWasabi). For host fever sensing experiments, SCID mice injected with bacteria as described above were housed in an incubator preset to 41° C. for two hours and control mice were housed at room temperature. Following treatment, all mice were housed at room temperature for four hours, anaesthetized, and imaged using a Bio-Rad ChemiDoc MP imager with blue epi illumination and the 530/28 nm emission filter (mWasabi). Mouse images are representative of three independent in vivo experiments. Fever-induced and control mice were littermates randomly selected for each experimental condition. Investigators were not blinded to group allocation because no subjective evaluations were performed. For host confinement experiments, BALB/c mice were given drinking water containing 0.5 mg/mL of ampicillin for 24 h, and then starved for food overnight. E. coli were grown in 2×YT media containing ampicillin at 37° C. with shaking until $OD_{600}$ of 0.6. Cultures were pelleted and resuspended at $10^8$ cells/mL in PBS containing 1.5% $NaHCO_3$. 200 μL of the suspension was administered orally using a gavage needle. Food was returned to the mice and the drinking water contained ampicillin throughout the entire experiment. Fresh fecal samples were collected from each mouse 5 hrs after gavage and incubated at 37° C. or 25° C. for 24 h, then weighed, homogenized in PBS at 0.1 g/mL, diluted and plated onto LB agar plates containing ampicillin. Plates were then incubated overnight at 25° C. and 37° C. Bacterial colonies were counted as described above for in vitro toxin-antitoxin experiments. The sample size was N=5 mice, which was chosen based on preliminary experiments indicating that it would be sufficient to detect significant differences in mean values.

Electrophoretic Mobility Shift Assay.

Interaction between TlpA, $\sigma^{70}$-RNAp holoenzyme and DNA was demonstrated using a gel shift assay. For this, 50 pmoles of fluorescein-labeled double stranded DNA representing the TlpA operator with flanking padding sequences (70 base pairs in total) was incubated with either 50 pmoles of TlpA protein or 5 Units (8.5 pmoles) $\sigma^{70}$-RNAp holoenzyme (NEB M0551S) individually in 50 uL reaction buffer comprising 40 mM Tris-HCl, 150 mM KCl, 10 mM MgCl2, 0.01% Triton-X-100 and 1 mM DTT at a pH of 7.5. As a negative control, the wildtype TlpA operator was replaced with a scrambled version. Following incubation at 37° C. for 30 minutes, 10 uL of the reaction mixture was supplemented with glycerol to a final concentration of 5% and loaded in a nondenaturing 4% polyacrylamide resolving gel. The gel was run at 65 V for 90 minutes in buffer comprising 45 mM Tris-borate and 1 mM EDTA at a pH of 8.3. DNA was visualized using Bio-Rad ChemiDoc MP imager using blue epifluorescent illumination and the 530/28 nm emission filter.

Statistics and Replicates.

Data is plotted and reported in the text as the mean±SEM. Sample size is N=4 biological replicates in all in vitro experiments unless otherwise stated. This sample size was chosen based on preliminary experiments indicating that it would be sufficient to detect significant differences in mean values. P-values were calculated using a two-tailed unpaired heteroscedastic t-test.

Example 1: High-Performance Temperature Sensitive Transcription Factors

In order to engineer new families of robust, tunable, orthogonal thermal bioswitches, the performance of six temperature-dependent transcriptional repressors and six endogenous heat shock promoters was characterized. The panel included TlpA, a transcriptional autorepressor from the virulence plasmid of Salmonella typhimurium. This protein contains an approximately 300 residue C-terminal coiled-coil domain that undergoes sharp, temperature-dependent uncoiling between 37° C. and 45° C., and an N-terminal DNA binding domain that, in its low-temperature dimeric state, blocks transcription from the 52 bp TlpA operator/promoter[1, 20]. In addition, a well-known temperature-sensitive variant of the bacteriophage λ repressor cI (mutant cI$^{857}$, here referred to as TcI) acting on a tandem pR/pL operator/promoter[50] was tested. In most previous applications, TcI repression has been modulated via large changes in temperature (e.g., steps from 30° C. to 42° C.)[50]. However, its original description as a virulence factor suggested that much sharper switching may be possible[51]. Alongside TlpA and TcI, four reported temperature-sensitive mutants of the E. coli repressors TetR (A89D and I193N)[52] and LacI (A241T and G265D)[53, 54] were tested, together with a panel of endogenous heat shock promoters, including GrpE, HtpG, Lon, RpoH, Clp and DnaK (FIG. 2a).

Figure 2:
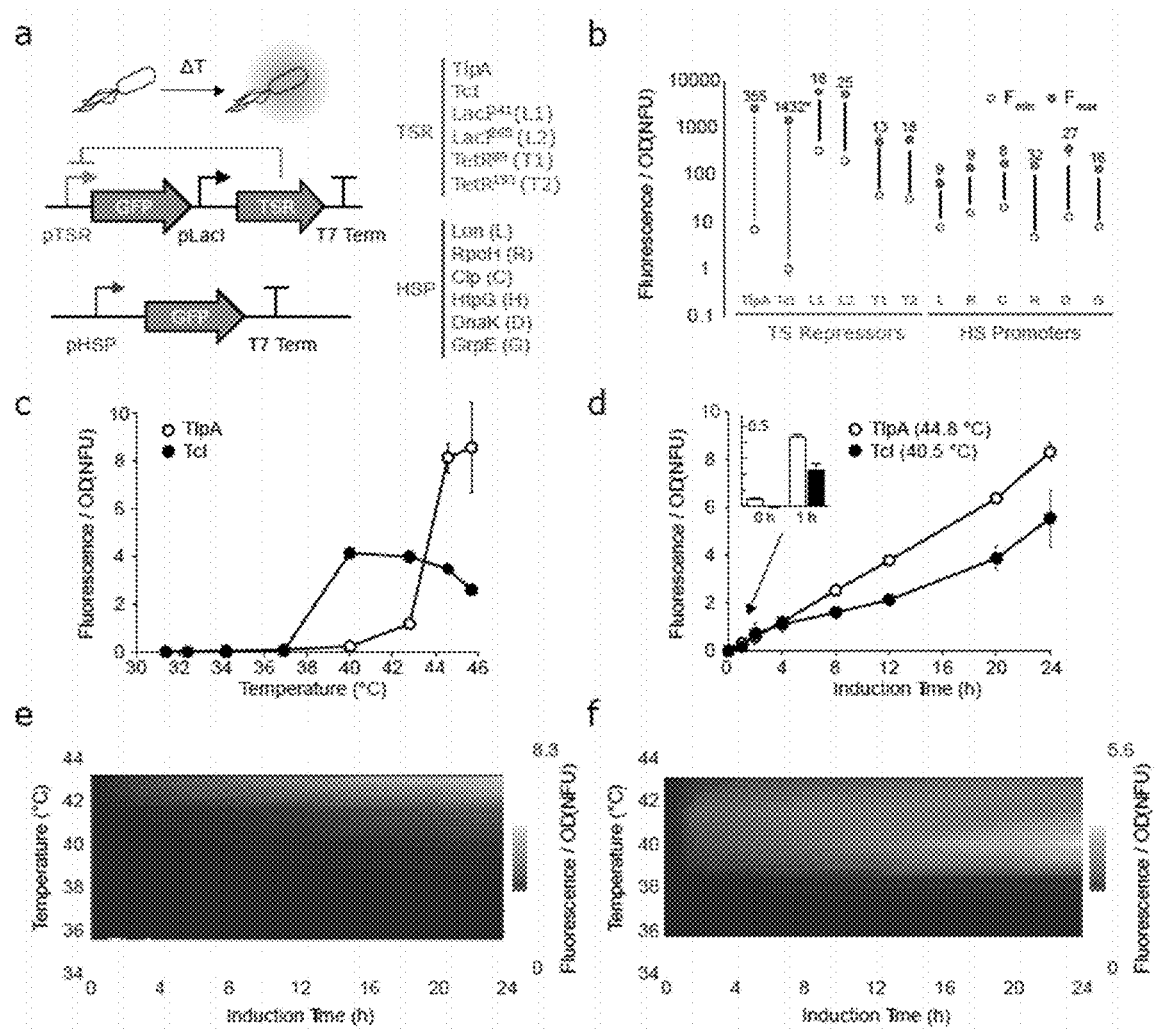
FIG. 2 shows exemplary results of characterization of high-performance thermal bioswitches.
Figure 3:
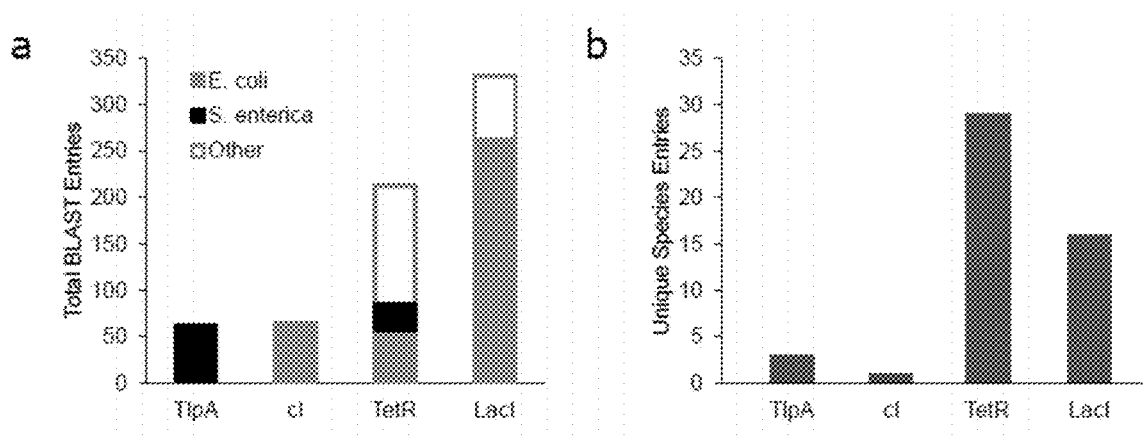
FIG. 3 shows graphs of examples of prevalence of repressor sequences in bacteria.

The performance of these constructs is summarized in FIG. 2b. TlpA and TcI had by far the largest dynamic ranges (355±45 and >1,432, respectively), reflecting a combination of tighter repression at sub-threshold temperatures and stronger promoter activity above threshold. Both of these repressors show sharp thermal transitions, with greater than 30-fold induction over ranges of 5° C. and 3° C. centered at 43.5° C. and 39.5° C. for TlpA and TcI, respectively (FIG. 2c). Furthermore, both systems are capable of rapid induction, with greater than 10-fold changes in expression observed after a 1 hour thermal stimulus (FIG. 2d). Complete time-temperature induction profiles for TlpA and TcI are shown in FIG. 2, e-f. In addition to their high performance, TlpA and TcI are expected to be more orthogonal to cellular machinery than both the native heat shock promoters and the engineered TetR and LacI repressors, the latter of which are utilized in multiple endogenous and engineered gene circuits[22-24]. A homology search[25] showed that TlpA and TcI repressors are present in far fewer bacterial species than either TetR or LacI (FIG. 3). Based on these factors, TlpA and TcI were chosen as starting points for further bioswitch engineering.

Figure 4:
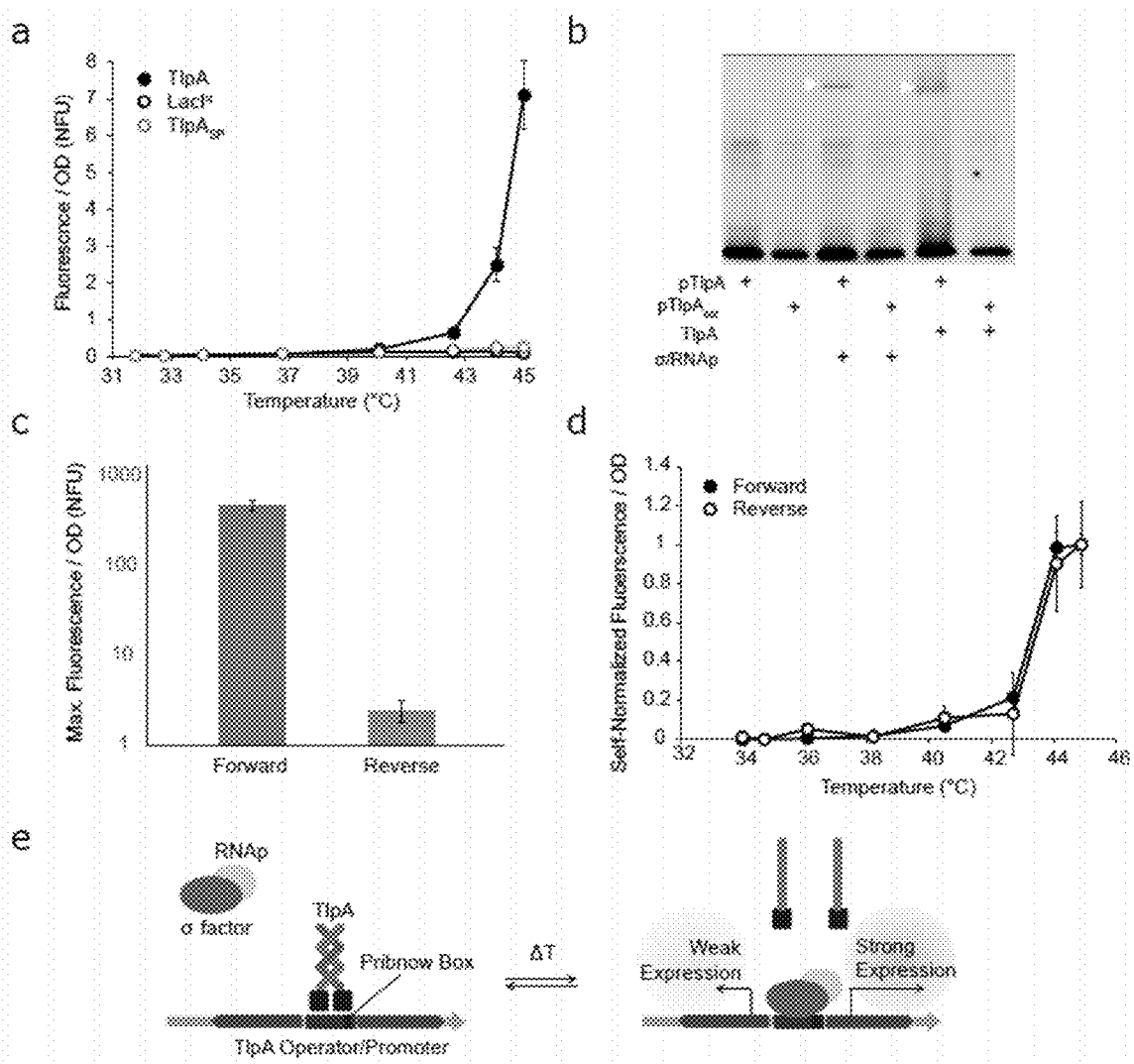
FIG. 4 shows exemplary results indicating mechanisms and bidirectional activity of the TlpA operator.

Since the TlpA operator/promoter has not been studied in E. coli, its molecular mechanisms were characterized to inform its utilization in genetic circuits. As shown in FIG. 4, the TlpA operator is a strong promoter (88-fold stronger than LacI$^Q$) driven by the transcription factor $\sigma^{70}$. Interestingly, this promoter has bidirectional activity with identical thermal regulation in both orientations, but approximately 200-fold lower maximal expression in the reverse direction (FIG. 4, c-d). This property will enable convenient adjustment of TlpA-regulated expression according to circuit requirements.

Example 2: Tuning Bioswitch Activation Temperatures

Figure 5:
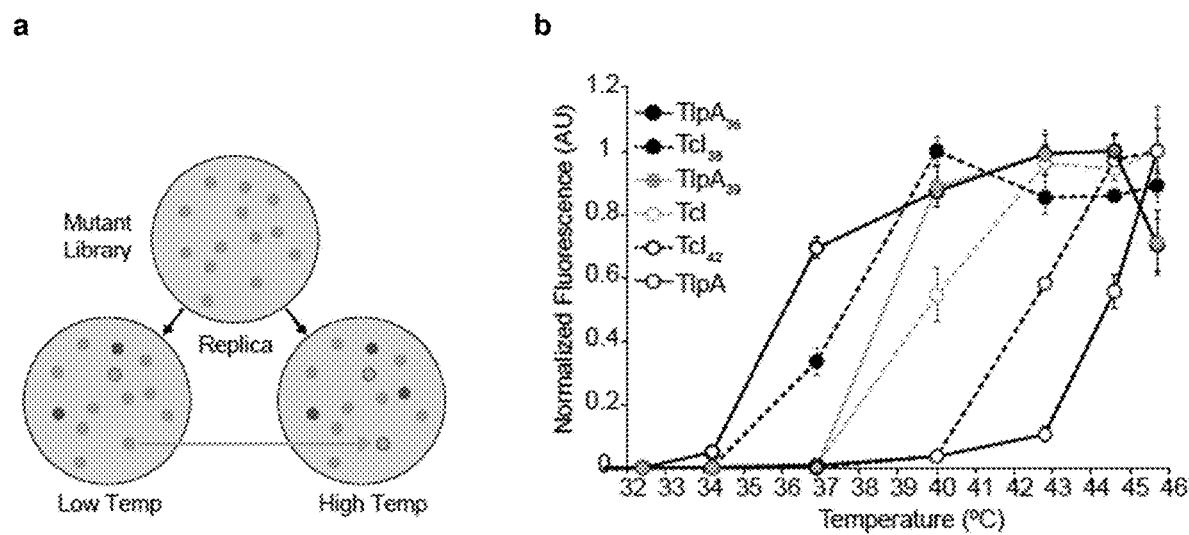
FIG. 5(a) shows an illustration of an exemplary screening strategy used to identify temperature-shifted repressor variants. A library of bacterial colonies transformed with plasmids comprising mutated repressor protein variants is replica-plated and incubated at low temperature or high temperature and fluorescence of colonies is visualized. The replica plated colony indicated by the horizontal arrow shows no fluorescent reporter expression at low temperature, and shows reporter fluorescence at high temperature, indicating de-repression at the high temperature.
FIG. 5(b) shows a graph of exemplary self-normalized fluorescence/OD profiles for a set of TlpA (solid lines) and TcI (dashed lines) bioswitches, demonstrating a range of transition temperatures. Here, 'self-normalized' indicates that the maximal fluorescence/OD measurement for each variant was given a value of 1.0.

Applications in microbial therapy require thermal bioswitches that activate at different transition temperatures. For example, a host colonization sensor should be activated at 37° C., while a fever detector may work best with a thermal threshold of 39° C., and a focused ultrasound-activated switch may require a transition point of 41° C. to avoid nonspecific actuation. Synthetic biology applications outside biomedicine may likewise have a variety of thermal requirements. It is thus highly desirable to be able to tune thermal bioswitches to activate at new temperatures while retaining sharp, robust switching performance. To enable such tuning of TlpA and TcI, a simple and effective high-throughput assay was devised based on colony fluorescence. E. coli expressing GFP under the control of mutant repressors (generated by error-prone PCR) was grown on solid media and the colonies were replica-plated onto separate plates for simultaneous incubation at desired "off" and "on" temperatures (FIG. 5a). Images of plates were then taken with wide-field fluorescence, as shown in FIG. 6a. As expected, many colonies show constitutive expression (ostensibly due to loss of repressor function), while others fail to de-repress (most likely retaining their original high transition point). However, several colonies show thermal induction in the desired regime. Within each screen, several such colonies were selected to undergo liquid phase characterization of induction temperature, switching sharpness, and expression levels (FIG. 6b). From these variants, mutants were selected that retained the desirable performance characteristics of the wild type repressor, but with shifted transition temperatures.

Figure 7:
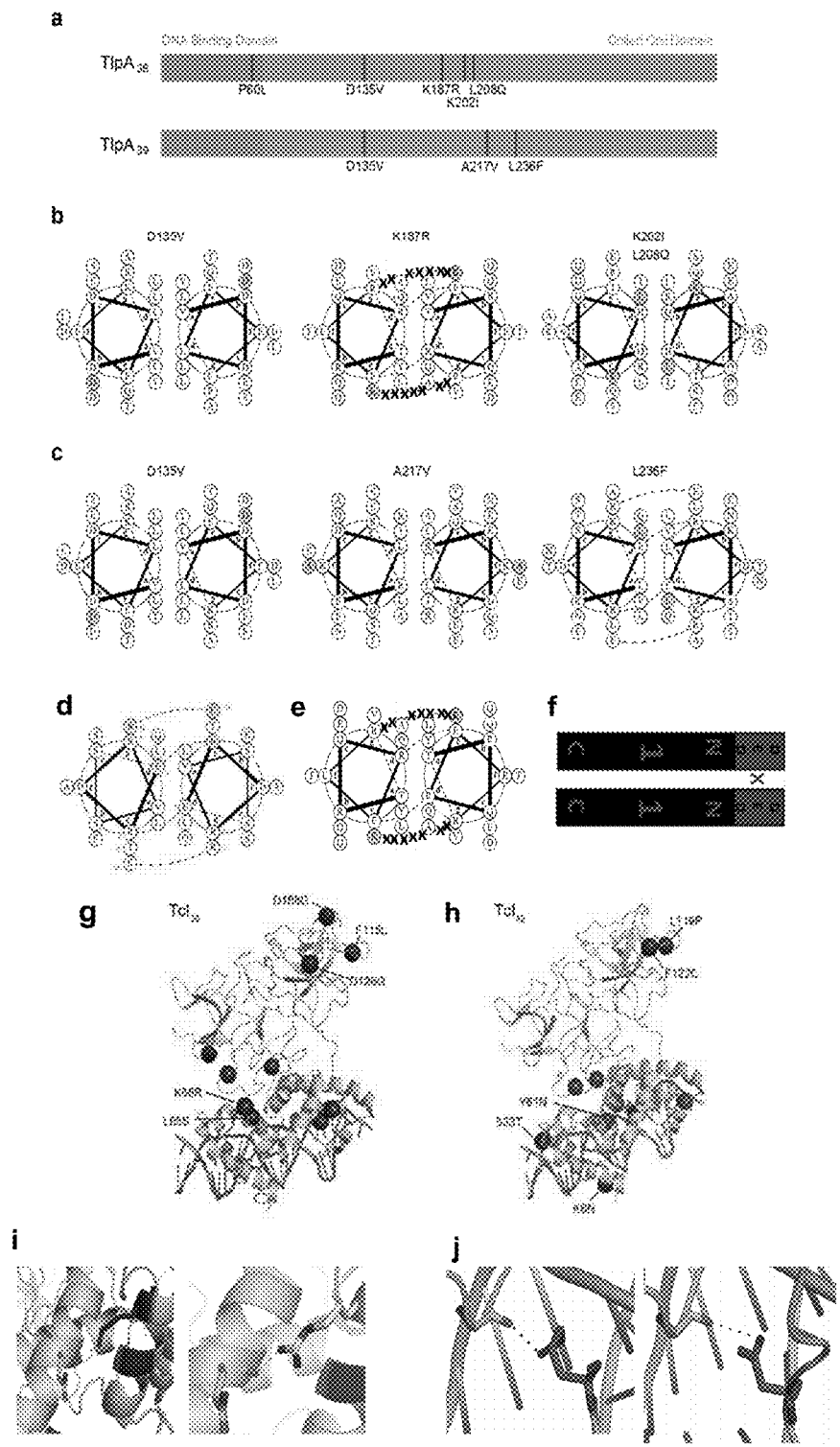
FIG. 7(a)-(c) shows positions of mutations in selected exemplary variants of TlpA.
FIG. 7(d) shows an example of a proposed TlpA variant mutated by swapping pairs of coulombically-attracting amino acid residues with those expected to experience coulombic repulsion (indicated by inter-monomeric dashed lines between R and E residues) which is expected to shift the de-dimerization temperature threshold down. Amino acid mutations shown in FIG. 7(d) are E282, R283, R292, and E297.
FIG. 7(e) shows an example of a proposed TlpA variant mutated by swapping pairs of coulombically-repelling amino acid residues with those no longer expected to experience coulombic repulsion (inter-monomeric lines comprised of small 'x' symbols between the indicated R and K residues) which is expected to shift the de-dimerization temperature threshold up. Amino acid mutations shown in FIG. 7(e) are R182 and K187.
FIG. 7(f) shows an example of appending short charged sequences to TlpA protein so as to effect coulombic repulsion. Here the short charged protein sequences indicated by "DED" coulombically repel each other (indicated by an 'x' symbol), which is expected to shift the de-dimerization temperature threshold down.
FIG. 7(g)-(h) shows positions of mutations in selected exemplary variants of TcI. The crystal structure of the wild type lambda repressor (Protein Data Bank (PDB) code 3BDN) was used as the homology model[8]. The original temperature-sensitizing mutation in cI$^{857}$ A67T is not shown. The M1V mutation is not depicted because residue 1 was not reported in the crystal structure.
FIG. 7(i) shows a zoomed-in view of part of the TcI crystal structural model showing an example of replacing polar residues at the TcI dimerization core interface with different (e.g. bulkier) polar residues that are sterically inhibited from forming polar contacts as efficiently as in the original protein. The image shows a zoomed-in view of the K68R mutation in the TcI$_{38}$ variant. The left panel shows the structure of TcI with the original K68 residue of TcI. The right panel shows a computational prediction of TcI structure with a K68R mutation based on the M phantom.

Screening of TlpA mutants at off-on temperatures of 30-37° C. and 37-40° C. produced high-performance bioswitches centered at 36° C. and 39° C., respectively, which were named TlpA$_{36}$ and TlpA$_{39}$ (FIG. 6c). For TcI, both downshifted (TcI$_{38}$, $T_m$=38° C.) and upshifted (TcI$_{42}$, $T_m$=42° C.) variants relative to the original protein were selected (FIG. 6d). Together, the engineered TlpA and TcI repressor families cover the biomedically relevant range of 32° C. to 46° C. (FIG. 5b) while demonstrating a dynamic range similar to that of the wild type protein (Table 3). The amino acid substitutions identified in these bioswitch variants are shown in FIG. 7. The observed decrease in fluorescence at the highest temperatures tested is possibly be due to thermal instability of the cell's transcriptional and translational machinery. Remarkably, a single round of mutagenesis was sufficient in all cases to obtain at least one variant with the desired switching behavior, suggesting that both TlpA and TcI are highly tunable for a broad range of applications.

TABLE 3

Mutant and wild type bioswitch performance

| Variant | Fold Change | SEM (±) | $T_{off}$ | $T_{max}$ |
| --- | --- | --- | --- | --- |
| TlpA | 355 | 45 | 31.4 | 44.6 |
| TlpA$_{36}$ | 370 | 63 | 31.4 | 44.6 |
| TlpA$_{39}$ | 1523 | 434 | 31.4 | 44.6 |
| TcI | 1432 | 404 | 34.2 | 40 |
| TcI$_{38}$ | 1032 | 160 | 32.4 | 40 |
| TcI$_{42}$ | 1692 | 444 | 32.4 | 45.7 |

The reported $T_{off}$ for each variant is the lowest temperature at which fluorescence could be detected above noise. $T_{max}$ is the temperature at which fluorescence was maximal.

Example 3. Thermal Logic Circuits Using Orthogonal Bioswitches

Figure 8:
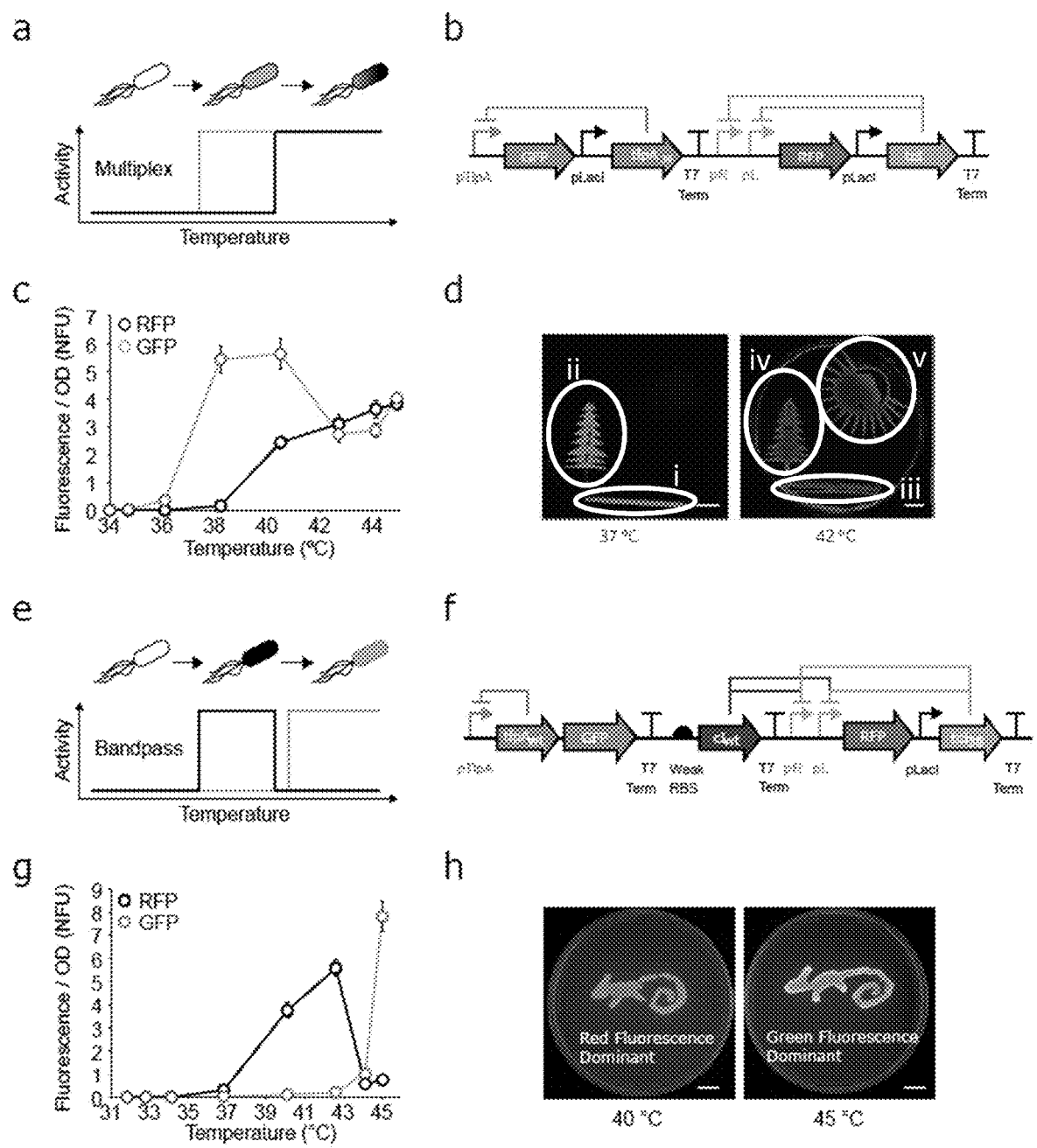

To enable microbial therapy applications, it is useful to develop thermal logic circuits capable of controlling multiple functions at different temperatures or confining activity to within a narrow thermal range. This would enable cells to, for example, initiate one therapeutic function upon host colonization and switch to a different function during a host fever response or local activation with focused ultrasound. It was hypothesized that since TlpA and TcI act on orthogonal target sequences, they could be combined in circuits designed for multiplexed thermal control or band-pass activation of microbial function. To assess the first possibility (FIG. 8a), a construct was made encoding a GFP modulated by TlpA$_{36}$ and an RFP regulated by TcI (FIG. 8b). As predicted, upon exposure to a range of temperatures, the two reporter genes were activated independently at their expected thresholds, with no apparent crosstalk in their induction (FIG. 8c). Independent thermal control of the co-expressed circuits is illustrated by spatially patterned bacterial variants incubated at 37° C. and 42° C. (FIG. 8d). Next, to develop a thermal band-pass filter (FIG. 8e), a circuit was engineered placing the expression of RFP under the control of the lambda operator, gated by both TcI (turning on above 36° C.) and the temperature-independent wild type cI repressor, which was itself placed under the control of TlpA (activating above 43° C.) as shown in FIG. 8f. The cI open reading frame was preceded by a T7 terminator and a weak ribosome binding site to reduce buildup of this repressor at 40-43° C. due to leakage of the upstream TlpA operon. This resulted in RFP expression confined between 36 and 44° C., while simultaneously turning on GFP above RFP's turn-off temperature (FIG. 8, g-h).

Example 4. Spatially Targeted Control Using Focused Ultrasound

After developing TlpA and TcI-based thermal bioswitches, their utility was demonstrated in three prototypical microbial therapy scenarios. First, the ability of thermal bioswitches to mediate spatially-selective control of microbial therapies using focused ultrasound was tested, a modality that is well established in its ability to elevate temperatures in deep tissues with millimeter spatial precision [55] and utilized clinically to treat diseases such as cancer[56] and essential tremor[57]. Focused ultrasound has been used to activate gene expression in mammalian cells[58], but apparently has not been employed to control the activity of microbes in vivo. Such control could be highly advantageous in applications where the activity of a systemically administered microbial therapy needs to be localized to a specific anatomical site, such as a deep-seated tumor or section of the gastrointestinal tract, which would be difficult to reach with optogenetic triggers. To test this concept, gene expression was first activated using focused ultrasound in tissue-mimicking phantoms under the guidance of magnetic resonance imaging (MRI)[59] (FIG. 9a). This guidance enabled precise spatial targeting of the ultrasound focus and real-time monitoring and adjustment of local temperature. This technique was first applied to a flat lawn of E. coli containing the multiplexed expression circuit shown in FIG. 8b. This specimen was assembled with a tissue-mimicking tofu phantom, and steady-state focal heating over 45 minutes resulted in a radial thermal gradient with an average focal temperature of 42° C., as observed by real-time MRI thermometry (FIG. 9b). A corresponding pattern of spatially localized fluorescence is seen in FIG. 9c.

To establish the feasibility of this approach in vivo, E. coli expressing GFP under the control of TlpA$_{36}$ were injected subcutaneously into both hindlimbs of a nude mouse and MRI-guided focused ultrasound was applied to one location (FIG. 9d) to produce a local steady-state temperature of 41° C. for 45 min to 1 hour. This thermal dose is below the damage thresholds for mammalian tissues such as muscle and brain[60, 61]. In vivo fluorescence imaging four hours after ultrasound treatment showed robust expression of GFP specifically at the ultrasound-targeted anatomical site (FIG. 9e). TlpA$_{36}$ was selected as the thermal bioswitch for these experiments because its activation threshold is approximately 4° C. above the typical murine cutaneous temperature[62], a sufficient difference for site-specific ultrasound activation.

Example 5. Programmed Responses to Mammalian Host Temperature

Thermal bioswitches can be used to develop autonomous thermosensitive microbes responsive to endogenous changes in host temperature. First, it was investigated whether bacteria can be engineered to sense and respond to a host fever (FIG. 10a). One flank of a nude mouse was subcutaneously injected with E. coli expressing GFP under the control of TlpA$_{36}$, and the other flank with E. coli expressing GFP controlled by wild type TlpA as a high-threshold control for non-specific activation. The mouse was then housed at 41° C. for two hours in an established fever model paradigm[63]. In vivo fluorescent imaging four hours after fever induction shows robust expression of GFP in the flank injected with TlpA$_{36}$-regulated bacteria (FIG. 10b). No significant activation is seen in the opposite flank or in a mouse housed at room temperature (FIG. 10c).

Second, it was tested whether a thermal bioswitch operating at 37° C. could be used to confine the activity of genetically engineered microbes to the in vivo environment of a mammalian host and thereby limit the potential for environmental contamination. Towards this end, a genetic circuit was designed in which TlpA$_{36}$ controls the expression of CcdA, a bacterial antitoxin, while constitutively expressing the toxin CcdB, thereby restricting growth to temperatures above 37° C. (FIG. 10d). A degradation tag was fused to CcdA to accelerate cell death at non-permissive temperatures. Bacteria carrying this plasmid grew normally above this permissive temperature, while bacteria incubated at 25° C. had significantly reduced survival as demonstrated by their CFU counts in FIG. 10e. These bacteria were administered to mice by oral gavage and fecal pellets were collected after five hours to allow transit through the gastrointestinal tract. The pellets were kept for 24 hours at either 25° C., corresponding to excretion into the ambient environment, or at 37° C., equivalent to persistent residence in the gut, and subsequently assayed for colony formation. The survival of cells excreted into ambient temperature was reduced by ten thousand fold compared to cells maintained under host conditions (FIG. 10f).

Example 6. Calculation of Hill Coefficient

Circular dichroism (CD) spectra were recorded with a Aviv 62DS. Acquisition parameters were set as follows: spectral width 300-200 nm, scanning speed 50 nm/min, bandwidth 2 nm, in RNA-free conditions, in 1x Phosphate buffered saline, pH 7.4. CD melting curves were recorded with a temperature slope of 1° C./min at a wavelength of 222 nm between 25° C. and 50° C. The CD melting curves were normalized and fitted according to Hill's equation (Eq. 2).

Figure 23A:
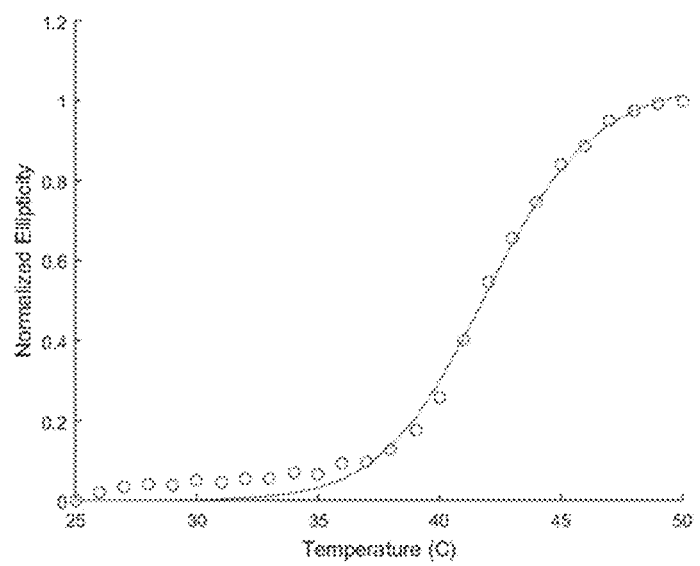
FIGS. 23A-D show the CD melting curves normalized and fitted according to Hill's equation for TlpA-CC WT, TlpA-CC-DED, DED-TlpA-CC and tropomysin.
Figure 23B:
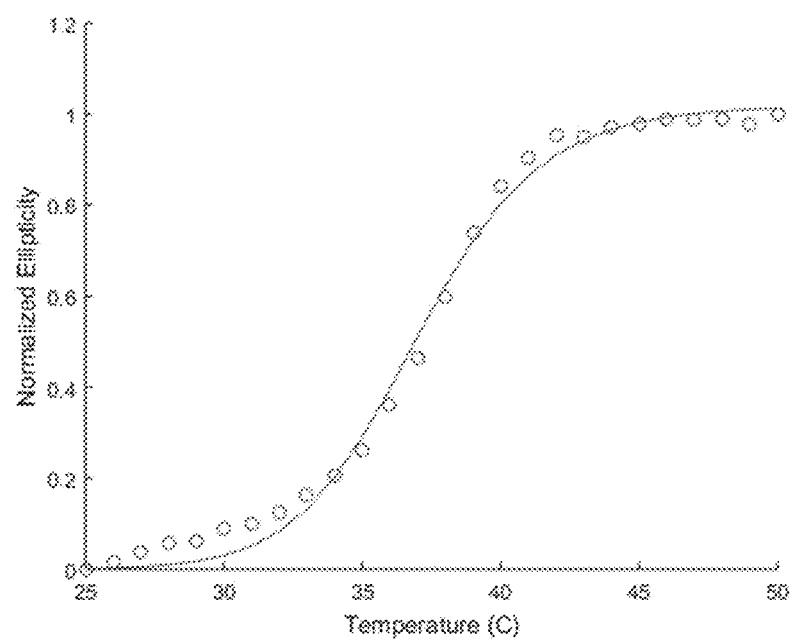
Figure 23C:
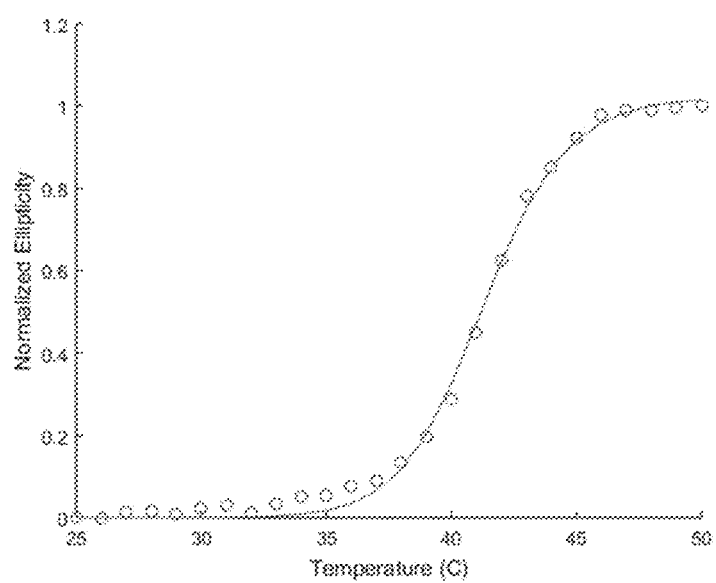
Figure 23D:
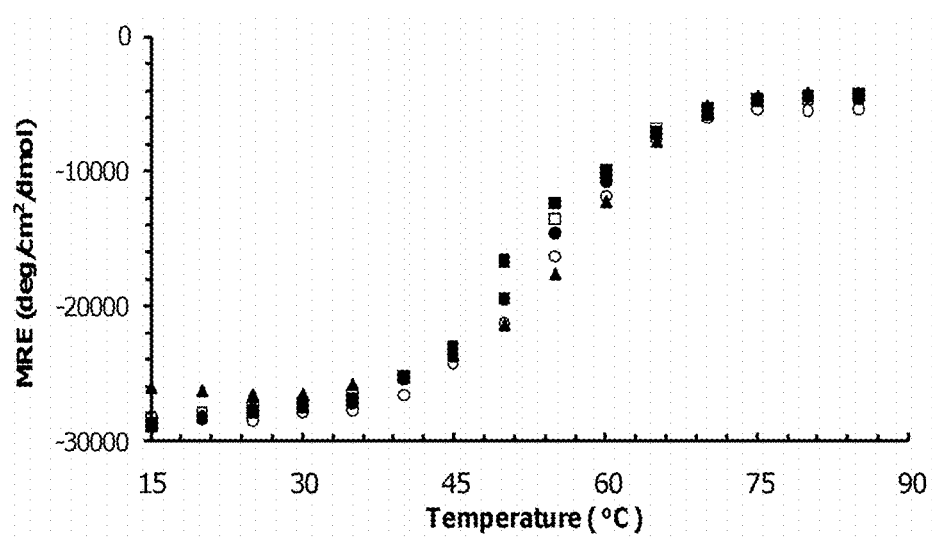

FIGS. 23A-C show the CD melting curves normalized and fitted according to Hill's equations for TlpA-CC WT (FIG. 23A), TlpA-CC-DED (FIG. 23B), and DED-TlpA-CC (FIG. 23C). "DED" is a charged amino acid sequence (Asp-Glu-Asp) appended to the N-terminus of the TlpA coiled-coil domain in DED-TlpA-CC and appended to the C-terminus of the TlpA coiled-coil domain in TlpA-CC-DED. The CD melting curve was also normalized and fitted for tropomysin for comparison (FIG. 23D). The proteins were provided at a concentration of 10 μM. The calculated Hill coefficients are listed in Table 4.

TABLE 4

Hill coefficients of TlpA, TlpA variants and Tropomyosin

| Name | Hill Coefficient |
| --- | --- |
| TlpA_CC_wt_10uM | 19.1475 |
| TlpA_CC_DED_10uM | 16.7159 |
| DED_TlpA_CC_10uM | 24.7294 |
| Tropomyosin | 9.7109 |

The examples set forth above are provided to give those of ordinary skill in the art a complete disclosure and description of how to make and use the embodiments of the materials, compositions, systems and methods of the disclosure, and are not intended to limit the scope of what the inventors regard as their disclosure. Those skilled in the art will recognize how to adapt the features of the exemplified methods and arrangements to additional genetic circuit, related nodes, molecular components, sets of polynucleotides, polypeptides and/or metabolites, in according to various embodiments and scope of the claims.

All patents and publications mentioned in the specification are indicative of the levels of skill of those skilled in the art to which the disclosure pertains.

The entire disclosure of each document cited (including patents, patent applications, journal articles, abstracts, laboratory manuals, books, or other disclosures) in the Background, Summary, Detailed Description, and Examples is hereby incorporated herein by reference. All references cited in this disclosure are incorporated by reference to the same extent as if each reference had been incorporated by reference in its entirety individually. However, if any inconsistency arises between a cited reference and the present disclosure, the present disclosure takes precedence. Further, the computer readable form of the sequence listing of the ASCII text file P1984-US-Seq-List-ST25 is incorporated herein by reference in its entirety.

The terms and expressions which have been employed herein are used as terms of description and not of limitation, and there is no intention in the use of such terms and expressions of excluding any equivalents of the features shown and described or portions thereof, but it is recognized that various modifications are possible within the scope of the disclosure claimed. Thus, it should be understood that although the disclosure has been specifically disclosed by embodiments, exemplary embodiments and optional features, modification and variation of the concepts herein disclosed can be resorted to by those skilled in the art, and that such modifications and variations are considered to be within the scope of this disclosure as defined by the appended claims.

It is also to be understood that the terminology used herein is for the purpose of describing particular embodiments only, and is not intended to be limiting. As used in this specification and the appended claims, the singular forms "a," "an," and "the" include plural referents unless the content clearly dictates otherwise. The term "plurality" includes two or more referents unless the content clearly dictates otherwise. Unless defined otherwise, all technical and scientific terms used herein have the same meaning as commonly understood by one of ordinary skill in the art to which the disclosure pertains.

When a Markush group or other grouping is used herein, all individual members of the group and all combinations and possible subcombinations of the group are intended to be individually included in the disclosure. Every combination of components or materials described or exemplified herein can be used to practice the disclosure, unless otherwise stated. One of ordinary skill in the art will appreciate that methods, device elements, and materials other than those specifically exemplified may be employed in the practice of the disclosure without resort to undue experimentation. All art-known functional equivalents, of any such methods, device elements, and materials are intended to be included in this disclosure. Whenever a range is given in the specification, for example, a temperature range, a frequency range, a time range, or a composition range, all intermediate ranges and all subranges, as well as, all individual values included in the ranges given are intended to be included in the disclosure. Any one or more individual members of a range or group disclosed herein may be excluded from a claim of this disclosure. The disclosure illustratively described herein suitably may be practiced in the absence of any element or elements, limitation or limitations which is not specifically disclosed herein.

A number of embodiments of the disclosure have been described. The specific embodiments provided herein are examples of useful embodiments of the invention and it will be apparent to one skilled in the art that the disclosure can be carried out using a large number of variations of the devices, device components, methods steps set forth in the present description. As will be obvious to one of skill in the art, methods and devices useful for the present methods may include a large number of optional composition and processing elements and steps.

In particular, it will be understood that various modifications may be made without departing from the spirit and scope of the present disclosure. Accordingly, other embodiments are within the scope of the following claims.

REFERENCES

1. Hurme, R., et al., *DNA binding exerted by a bacterial gene regulator with an extensive coiled-coil domain.* J Biol Chem, 1996. 271(21): p. 12626-31.
2. Marr, M. T. and J. W. Roberts, *Promoter recognition as measured by binding of polymerase to nontemplate strand oligonucleotide.* Science, 1997. 276(5316): p. 1258-60.
3. Koski, P., et al., *A new alpha-helical coiled coil protein encoded by the Salmonella typhimurium virulence plasmid.* J Biol Chem, 1992. 267(17): p. 12258-65.
4. Lupas, A., M. Van Dyke, and J. Stock, *Predicting coiled coils from protein sequences. Science,* 1991. 252(5009): p. 1162-4.
5. McDonnell, A. V., et al., *Paircoil2: improved prediction of coiled coils from sequence. Bioinformatics,* 2006. 22(3): p. 356-8.
6. Vincent, T. L., P. J. Green, and D. N. Woolfson, *LOGICOIL—multi-state prediction of coiled-coil oligomeric state.* Bioinformatics, 2013. 29(1): p. 69-76.
7. Grigoryan, G. and A. E. Keating, *Structural specificity in coiled-coil interactions.* Curr Opin Struct Biol, 2008. 18(4): p. 477-83.
8. Stayrook, S., et al., *Crystal structure of the lambda repressor and a model for pairwise cooperative operator binding.* Nature, 2008. 452(7190): p. 1022-5.
9. Kyte, J. and R. F. Doolittle, *A simple method for displaying the hydropathic character of a protein.* Journal of molecular biology, 1982. 157(1): p. 105-132.
10. Lam, K. S., *Mini-review. Application of combinatorial library methods in cancer research and drug discovery.* Anti-cancer drug design, 1997. 12(3): p. 145-167.
11. Chappell, J., et al., *The centrality of RNA for engineering gene expression.* Biotechnology Journal, 2013. 8(12): p. 1379-1395.
12. Berman, H. M., et al., *The protein data bank.* Acta Crystallographica Section D: Biological Crystallography, 2002. 58(6): p. 899-907.
13. Lohse, M. B., et al., *Identification and characterization of a previously undescribed family of sequence-specific DNA-binding domains.* Proceedings of the National Academy of Sciences, 2013. 110(19): p. 7660-7665.
14. Flynn, R. L. and L. Zou, *Oligonucleotide/oligosaccharide-binding fold proteins: a growing family of genome guardians.* Critical Reviews in Biochemistry and Molecular Biology, 2010. 45(4): p. 266-275.
15. Chen, X., J. L. Zaro, and W.-C. Shen, *Fusion protein linkers: property, design and functionality.* Advanced drug delivery reviews, 2013. 65(10): p. 1357-1369.
16. Ye, Y. and A. Godzik, *Flexible structure alignment by chaining aligned fragment pairs allowing twists.* Bioinformatics, 2003. 19(suppl 2): p. ii246-ii255.
17. Maiti, R., et al., *SuperPose: a simple server for sophisticated structural superposition.* Nucleic acids research, 2004. 32(suppl 2): p. W590-W594.
18. Gelly, J.-C., et al., *iPBA: a tool for protein structure comparison using sequence alignment strategies.* Nucleic acids research, 2011. 39(suppl 2): p. W18-W23.
19. Ilinkin, I., J. Ye, and R. Janardan, *Multiple structure alignment and consensus identification for proteins.* BMC bioinformatics, 2010. 11(1): p. 1.
20. Hurme, R., et al., *A proteinaceous gene regulatory thermometer in Salmonella.* Cell, 1997. 90(1): p. 55-64.
21. Piraner, D. I., et al., *Tunable thermal bioswitches for in vivo control of microbial therapeutics.* Nature Chemical Biology, 2016.
22. Wilson, C. J., et al., *The lactose repressor system: paradigms for regulation, allosteric behavior and protein folding.* Cell Mol Life Sci, 2007. 64(1): p. 3-16.
23. Bertram, R. and W. Hillen, *The application of Tet repressor in prokaryotic gene regulation and expression.* Microb Biotechnol, 2008. 1(1): p. 2-16.
24. Jensen, P. R., H. V. Westerhoff, and O. Michelsen, *The use of lac-type promoters in control analysis.* Eur J Biochem, 1993. 211(1-2): p. 181-91.
25. Altschul, S. F., et al., *Gapped BLAST and PSI-BLAST: a new generation of protein database search programs.* Nucleic acids research, 1997. 25(17): p. 3389-3402.
26. Drozdetskiy, A., et al., *JPred4: a protein secondary structure prediction server.* Nucleic acids research, 2015: p. gkv332.
27. Lauck, F., et al., *RosettaBackrub—a web server for flexible backbone protein structure modeling and design.* Nucleic acids research, 2010. 38(suppl 2): p. W569-W575.
28. Kuhlman, B., et al., *Design of a novel globular protein fold with atomic-level accuracy.* science, 2003. 302 (5649): p. 1364-1368.
29. Humphris, E. L. and T. Kortemme, *Prediction of protein-protein interface sequence diversity using flexible backbone computational protein design.* Structure, 2008. 16(12): p. 1777-1788.
30. Renfrew, P. D., et al., *Incorporation of noncanonical amino acids into Rosetta and use in computational protein-peptide interface design.* PLoS One, 2012. 7(3): p. e32637.
31. Pabo, C. O. and M. Lewis, *The operator-binding domain of lambda repressor: structure and DNA recognition.* Nature, 1982. 298: p. 443-447.
32. Hu, J. C., et al., *Sequence requirements for coiled-coils: analysis with repressor-GCN4 leucine zipper fusions.* Science, 1990. 250(1400): p. 0.
33. Mangan, S. and U. Alon, *Structure and function of the feed-forward loop network motif.* Proc Natl Acad Sci USA, 2003. 100(21): p. 11980-5.
34. Elowitz, M. B. and S. Leibler, *A synthetic oscillatory network of transcriptional regulators. Nature,* 2000. 403 (6767): p. 335-8.
35. Hooshangi, S., S. Thiberge, and R. Weiss, *Ultrasensitivity and noise propagation in a synthetic transcriptional cascade.* Proc Natl Acad Sci USA, 2005. 102(10): p. 3581-6.
36. Gardner, T. S., C. R. Cantor, and J. J. Collins, *Construction of a genetic toggle switch in Escherichia coli.* Nature, 2000. 403(6767): p. 339-42.

37. Shin, J. and V. Noireaux, *An E. coli cell-free expression toolbox: application to synthetic gene circuits and artificial cells*. ACS Synth Biol, 2012. 1(1): p. 29-41.
38. Ganguly, T., et al., *A point mutation at the C-terminal half of the repressor of temperate mycobacteriophage L1 affects its binding to the operator DNA*. BMB Reports, 2004. 37(6): p. 709-714.
39. Hemrich, J., et al., *The cI repressor of bacteriophage P1 operator-repressor interaction of wild-type and mutant repressor proteins*. Nucleic acids research, 1989. 17(19): p. 7681-7692.
40. Vogel, J., et al., *Temperature-sensitive mutations in the bacteriophage Mu c repressor locate a 63-amino-acid DNA-binding domain*. Journal of bacteriology, 1991. 173(20): p. 6568-6577.
41. Servant, P., C. Grandvalet, and P. Mazodier, *The RheA repressor is the thermosensor of the HSPJ8 heat shock response in Streptomyces albus*. Proceedings of the National Academy of Sciences, 2000. 97(7): p. 3538-3543.
42. Kamp, H. D. and D. E. Higgins, *A protein thermometer controls temperature-dependent transcription of flagellar motility genes in Listeria monocytogenes*. PLoS Pathog, 2011. 7(8): p. e1002153.
43. Chao, Y. P., et al., *Construction and characterization of thermo-inducible vectors derived from heat-sensitive lacI genes in combination with the T7 A1 promoter*. Biotechnology and bioengineering, 2002. 79(1): p. 1-8.
44. Wissmann, A., et al., *Selection for Tn10 tet repressor binding to tet operator in Escherichia coli: isolation of temperature-sensitive mutants and combinatorial mutagenesis in the DNA binding motif*. Genetics, 1991. 128(2): p. 225-232.
45. Herbst, K., et al., *Intrinsic thermal sensing controls proteolysis of Yersinia virulence regulator RovA*. PLoS Pathog, 2009. 5(5): p. e1000435.
46. Huang, D., W. J. Holtz, and M. M. Maharbiz., *A genetic bistable switch utilizing nonlinear protein degradation*. Journal of biological engineering, 2012. 6(1): p. 1.
47. Ai, H. W., et al., *Hue-shifted monomeric variants of Clavularia cyan fluorescent protein: identification of the molecular determinants of color and applications in fluorescence imaging*. BMC Biol, 2008. 6: p. 13.
48. Shaner, N. C., et al., *Improved monomeric red, orange and yellow fluorescent proteins derived from Discosoma sp. red fluorescent protein*. Nat Biotechnol, 2004. 22(12): p. 1567-72.
49. Wielgus-Kutrowska, B., et al., *Folding and unfolding of a non-fluorescent mutant of green fluorescent protein*. Journal of Physics: Condensed Matter, 2007. 19(28): p. 285223.
50. Valdez-Cruz, N. A., et al., *Production of recombinant proteins in E. coli by the heat inducible expression system based on the phage lambda pL and/or pR promoters*. Microb Cell Fact, 2010. 9: p. 18.
51. Sussman, R. and F. Jacob, *Sur un systeme de repression thermosensible chez le bacteriophage lambda d'Escherichia coli*. Comptes rendus hebdomadaires des séances de l'Académie des sciences, 1962(254): p. 1517-1519.
52. Wissmann, A., et al., *Selection for Tn10 tet repressor binding to tet operator in Escherichia coli: isolation of temperature-sensitive mutants and combinatorial mutagenesis in the DNA binding motif*. Genetics, 1991. 128(2): p. 225-32.
53. Chao, Y. P., et al., *Construction and characterization of thermo-inducible vectors derived from heat-sensitive lacI genes in combination with the T7 A1 promoter*. Biotechnol Bioeng, 2002. 79(1): p. 1-8.
54. McCabe, K. M., et al., *LacI(Ts)-regulated expression as an in situ intracellular biomolecular thermometer*. Appl Environ Microbiol, 2011. 77(9): p. 2863-8.
55. Haar, G. T. and C. Coussios, *High intensity focused ultrasound: physical principles and devices*. Int J Hyperthermia, 2007. 23(2): p. 89-104.
56. Al-Bataineh, O., J. Jenne, and P. Huber, *Clinical and future applications of high intensity focused ultrasound in cancer*. Cancer treatment reviews, 2012. 38(5): p. 346-353.
57. Elias, W. J., et al., *A pilot study of focused ultrasound thalamotomy for essential tremor*. New England Journal of Medicine, 2013. 369(7): p. 640-648.
58. Deckers, R., et al., *Image-guided, noninvasive, spatiotemporal control of gene expression*. Proceedings of the National Academy of Sciences, 2009. 106(4): p. 1175-1180.
59. Fite, B. Z., et al., *Magnetic resonance thermometry at 7T for real-time monitoring and correction of ultrasound induced mild hyperthermia*. PloS one, 2012. 7(4): p. e35509.
60. McDannold, N. J., et al., *Usefulness of MR Imaging-Derived Thermometry and Dosimetry in Determining the Threshold for Tissue Damage Induced by Thermal Surgery in Rabbits* 1. Radiology, 2000. 216(2): p. 517-523.
61. McDannold, N., et al., *MRI investigation of the threshold for thermally induced blood-brain barrier disruption and brain tissue damage in the rabbit brain*. Magnetic resonance in medicine, 2004. 51(5): p. 913-923.
62. Rudaya, A. Y., et al., *Thermoregulatory responses to lipopolysaccharide in the mouse: dependence on the dose and ambient temperature*. Am J Physiol Regul Integr Comp Physiol, 2005. 289(5): p. R1244-52.
63. Pritchard, M. T., et al., *Protocols for simulating the thermal component of fever: preclinical and clinical experience*. Methods, 2004. 32(1): p. 54-62.

SEQUENCE LISTING (488 sequences)

SEQ ID NO: 1 - protein, 7 aa, Artificial Sequence
  Synthetic polypeptide
  MISC_FEATURE (1)..(1): X1 is a hydrophobic amino acid
  MISC_FEATURE (1)..(7): X1 to X7 is repeated 2 times
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 2 - protein, 7 aa, Artificial Sequence
  Synthetic polypeptide
  MISC_FEATURE (1)..(7): X1 to X7 is repeated 3 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 3 - protein, 7 aa, Artificial Sequence
  Synthetic polypeptide
  MISC_FEATURE (1)..(7): X1 to X7 is repeated 4 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 4 - protein, 7 aa, Artificial Sequence
  Synthetic polypeptide
  MISC_FEATURE (1)..(7): X1 to X7 is repeated 5 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 5 - protein, 7 aa, Artificial Sequence
  Synthetic polypeptide
  MISC_FEATURE (1)..(7): X1 to X7 is repeated 6 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 6 - protein, 7 aa, Artificial Sequence
  Synthetic polypeptide
  MISC_FEATURE (1)..(7): X1 to X7 is repeated 7 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 7 - protein, 7 aa, Artificial Sequence
  Synthetic polypeptide
  MISC_FEATURE (1)..(7): X1 to X7 is repeated 8 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 8 - protein, 7 aa, Artificial Sequence
  Synthetic polypeptide
  MISC_FEATURE (1)..(7): X1 to X7 is repeated 9 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 9 - protein, 7 aa, Artificial Sequence
  Synthetic polypeptide
  MISC_FEATURE (1)..(7): X1 to X7 is repeated 10 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 10 - protein, 7 aa, Artificial Sequence
  Synthetic polypeptide
  MISC_FEATURE (1)..(7): X1 to X7 is repeated 11 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 11 - protein, 7 aa, Artificial Sequence
  Synthetic polypeptide
  MISC_FEATURE (1)..(7): X1 to X7 is repeated 12 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 12 - protein, 7 aa, Artificial Sequence
  Synthetic polypeptide
  MISC_FEATURE (1)..(7): X1 to X7 is repeated 13 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 13 - protein, 7 aa, Artificial Sequence
  Synthetic polypeptide
  MISC_FEATURE (1)..(7): X1 to X7 is repeated 14 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 14 - protein, 7 aa, Artificial Sequence
  Synthetic polypeptide
  MISC_FEATURE (1)..(7): X1 to X7 is repeated 15 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 15 - protein, 7 aa, Artificial Sequence
  Synthetic polypeptide
  MISC_FEATURE (1)..(7): X1 to X7 is repeated 16 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 16 - protein, 7 aa, Artificial Sequence
  Synthetic polypeptide
  MISC_FEATURE (1)..(7): X1 to X7 is repeated 17 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 17 - protein, 7 aa, Artificial Sequence
  Synthetic polypeptide
  MISC_FEATURE (1)..(7): X1 to X7 is repeated 18 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 18 - protein, 7 aa, Artificial Sequence
  Synthetic polypeptide
  MISC_FEATURE (1)..(7): X1 to X7 is repeated 19 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 19 - protein, 7 aa, Artificial Sequence
  Synthetic polypeptide
  MISC_FEATURE (1)..(7): X1 to X7 is repeated 20 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 20 - protein, 7 aa, Artificial Sequence
  Synthetic polypeptide
  MISC_FEATURE (1)..(7): X1 to X7 is repeated 21 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 21 - protein, 7 aa, Artificial Sequence
  Synthetic polypeptide
  MISC_FEATURE (1)..(7): X1 to X7 is repeated 22 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 22 - protein, 7 aa, Artificial Sequence
  Synthetic polypeptide
  MISC_FEATURE (1)..(7): X1 to X7 is repeated 23 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 23 - protein, 7 aa, Artificial Sequence
  Synthetic polypeptide
  MISC_FEATURE (1)..(7): X1 to X7 is repeated 24 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 24 - protein, 7 aa, Artificial Sequence
  Synthetic polypeptide
  MISC_FEATURE (1)..(7): X1 to X7 is repeated 25 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 25 - protein, 7 aa, Artificial Sequence
  Synthetic polypeptide
  MISC_FEATURE (1)..(7): X1 to X7 is repeated 26 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 26 - protein, 7 aa, Artificial Sequence
  Synthetic polypeptide
  MISC_FEATURE (1)..(7): X1 to X7 is repeated 27 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 27 - protein, 7 aa, Artificial Sequence
  Synthetic polypeptide
  MISC_FEATURE (1)..(7): X1 to X7 is repeated 28 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 28 - protein, 7 aa, Artificial Sequence
  Synthetic polypeptide
  MISC_FEATURE (1)..(7): X1 to X7 is repeated 29 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 29 - protein, 7 aa, Artificial Sequence
  Synthetic polypeptide
  MISC_FEATURE (1)..(7): X1 to X7 is repeated 30 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 30 - protein, 7 aa, Artificial Sequence
  Synthetic polypeptide
  MISC_FEATURE (1)..(7): X1 to X7 is repeated 31 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 31 - protein, 7 aa, Artificial Sequence
  Synthetic polypeptide
  MISC_FEATURE (1)..(7): X1 to X7 is repeated 32 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 32 - protein, 7 aa, Artificial Sequence
  Synthetic polypeptide
  MISC_FEATURE (1)..(7): X1 to X7 is repeated 33 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 33 - protein, 7 aa, Artificial Sequence
  Synthetic polypeptide
  MISC_FEATURE (1)..(7): X1 to X7 is repeated 34 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 34 - protein, 7 aa, Artificial Sequence
  Synthetic polypeptide
  MISC_FEATURE (1)..(7): X1 to X7 is repeated 35 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 35 - protein, 7 aa, Artificial Sequence
  Synthetic polypeptide
  MISC_FEATURE (1)..(7): X1 to X7 is repeated 36 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 36 - protein, 7 aa, Artificial Sequence
  Synthetic polypeptide
  MISC_FEATURE (1)..(7): X1 to X7 is repeated 37 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 37 - protein, 7 aa, Artificial Sequence
  Synthetic polypeptide
  MISC_FEATURE (1)..(7): X1 to X7 is repeated 38 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 38 - protein, 7 aa, Artificial Sequence
  Synthetic polypeptide
  MISC_FEATURE (1)..(7): X1 to X7 is repeated 39 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 39 - protein, 7 aa, Artificial Sequence
  Synthetic polypeptide
  MISC_FEATURE (1)..(7): X1 to X7 is repeated 40 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 40 - protein, 7 aa, Artificial Sequence
  Synthetic polypeptide
  MISC_FEATURE (1)..(7): X1 to X7 is repeated 41 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 41 - protein, 7 aa, Artificial Sequence
  Synthetic polypeptide
  MISC_FEATURE (1)..(7): X1 to X7 is repeated 42 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 42 - protein, 7 aa, Artificial Sequence
  Synthetic polypeptide
  MISC_FEATURE (1)..(7): X1 to X7 is repeated 43 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 43 - protein, 7 aa, Artificial Sequence
  Synthetic polypeptide
  MISC_FEATURE (1)..(7): X1 to X7 is repeated 44 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 44 - protein, 7 aa, Artificial Sequence
  Synthetic polypeptide
  MISC_FEATURE (1)..(7): X1 to X7 is repeated 45 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 45 - protein, 7 aa, Artificial Sequence
  Synthetic polypeptide
  MISC_FEATURE (1)..(7): X1 to X7 is repeated 46 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 46 - protein, 7 aa, Artificial Sequence
  Synthetic polypeptide
  MISC_FEATURE (1)..(7): X1 to X7 is repeated 47 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 47 - protein, 7 aa, Artificial Sequence
  Synthetic polypeptide
  MISC_FEATURE (1)..(7): X1 to X7 is repeated 48 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 48 - protein, 7 aa, Artificial Sequence
  Synthetic polypeptide
  MISC_FEATURE (1)..(7): X1 to X7 is repeated 49 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 49 - protein, 7 aa, Artificial Sequence
  Synthetic polypeptide
  MISC_FEATURE (1)..(7): X1 to X7 is repeated 50 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 50 - protein, 7 aa, Artificial Sequence
  Synthetic polypeptide
  MISC_FEATURE (1)..(7): X1 to X7 is repeated 51 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 51 - protein, 7 aa, Artificial Sequence
  Synthetic polypeptide
  MISC_FEATURE (1)..(7): X1 to X7 is repeated 52 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 52 - protein, 7 aa, Artificial Sequence
  Synthetic polypeptide
  MISC_FEATURE (1)..(7): X1 to X7 is repeated 53 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 53 - protein, 7 aa, Artificial Sequence
  Synthetic polypeptide
  MISC_FEATURE (1)..(7): X1 to X7 is repeated 54 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 54 - protein, 7 aa, Artificial Sequence
  Synthetic polypeptide
  MISC_FEATURE (1)..(7): X1 to X7 is repeated 55 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 55 - protein, 7 aa, Artificial Sequence
  Synthetic polypeptide
  MISC_FEATURE (1)..(7): X1 to X7 is repeated 56 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 56 - protein, 7 aa, Artificial Sequence
  Synthetic polypeptide
  MISC_FEATURE (1)..(7): X1 to X7 is repeated 57 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 57 - protein, 7 aa, Artificial Sequence
  Synthetic polypeptide
  MISC_FEATURE (1)..(7): X1 to X7 is repeated 58 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 58 - protein, 7 aa, Artificial Sequence
  Synthetic polypeptide
  MISC_FEATURE (1)..(7): X1 to X7 is repeated 59 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 59 - protein, 7 aa, Artificial Sequence
  Synthetic polypeptide
  MISC_FEATURE (1)..(7): X1 to X7 is repeated 60 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 60 - protein, 7 aa, Artificial Sequence
  Synthetic polypeptide
  MISC_FEATURE (1)..(7): X1 to X7 is repeated 61 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 61 - protein, 7 aa, Artificial Sequence
  Synthetic polypeptide
  MISC_FEATURE (1)..(7): X1 to X7 is repeated 62 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 62 - protein, 7 aa, Artificial Sequence
  Synthetic polypeptide
  MISC_FEATURE (1)..(7): X1 to X7 is repeated 63 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 63 - protein, 7 aa, Artificial Sequence
  Synthetic polypeptide
  MISC_FEATURE (1)..(7): X1 to X7 is repeated 64 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 64 - protein, 7 aa, Artificial Sequence
  Synthetic polypeptide
  MISC_FEATURE (1)..(7): X1 to X7 is repeated 65 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 65 - protein, 7 aa, Artificial Sequence
  Synthetic polypeptide
  MISC_FEATURE (1)..(7): X1 to X7 is repeated 66 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 66 - protein, 7 aa, Artificial Sequence
  Synthetic polypeptide
  MISC_FEATURE (1)..(7): X1 to X7 is repeated 67 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 67 - protein, 7 aa, Artificial Sequence
  Synthetic polypeptide
  MISC_FEATURE (1)..(7): X1 to X7 is repeated 68 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 68 - protein, 7 aa, Artificial Sequence
  Synthetic polypeptide
  MISC_FEATURE (1)..(7): X1 to X7 is repeated 69 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 69 - protein, 7 aa, Artificial Sequence
  Synthetic polypeptide
  MISC_FEATURE (1)..(7): X1 to X7 is repeated 70 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 70 - protein, 7 aa, Artificial Sequence
  Synthetic polypeptide
  MISC_FEATURE (1)..(7): X1 to X7 is repeated 71 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 71 - protein, 7 aa, Artificial Sequence
  Synthetic polypeptide
  MISC_FEATURE (1)..(7): X1 to X7 is repeated 72 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 72 - protein, 7 aa, Artificial Sequence
  Synthetic polypeptide
  MISC_FEATURE (1)..(7): X1 to X7 is repeated 73 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 73 - protein, 7 aa, Artificial Sequence
  Synthetic polypeptide
  MISC_FEATURE (1)..(7): X1 to X7 is repeated 74 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 74 - protein, 7 aa, Artificial Sequence
  Synthetic polypeptide
  MISC_FEATURE (1)..(7): X1 to X7 is repeated 75 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 75 - protein, 7 aa, Artificial Sequence
  Synthetic polypeptide
  MISC_FEATURE (1)..(7): X1 to X7 is repeated 76 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 76 - protein, 7 aa, Artificial Sequence
  Synthetic polypeptide
  MISC_FEATURE (1)..(7): X1 to X7 is repeated 77 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 77 - protein, 7 aa, Artificial Sequence
  Synthetic polypeptide
  MISC_FEATURE (1)..(7): X1 to X7 is repeated 78 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 78 - protein, 7 aa, Artificial Sequence
  Synthetic polypeptide
  MISC_FEATURE (1)..(7): X1 to X7 is repeated 79 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 79 - protein, 7 aa, Artificial Sequence
  Synthetic polypeptide
  MISC_FEATURE (1)..(7): X1 to X7 is repeated 80 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 80 - protein, 7 aa, Artificial Sequence
  Synthetic polypeptide
  MISC_FEATURE (1)..(7): X1 to X7 is repeated 81 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 81 - protein, 7 aa, Artificial Sequence
  Synthetic polypeptide
  MISC_FEATURE (1)..(7): X1 to X7 is repeated 82 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 82 - protein, 7 aa, Artificial Sequence
  Synthetic polypeptide
  MISC_FEATURE (1)..(7): X1 to X7 is repeated 83 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 83 - protein, 7 aa, Artificial Sequence
  Synthetic polypeptide
  MISC_FEATURE (1)..(7): X1 to X7 is repeated 84 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 84 - protein, 7 aa, Artificial Sequence
  Synthetic polypeptide
  MISC_FEATURE (1)..(7): X1 to X7 is repeated 85 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 85 - protein, 7 aa, Artificial Sequence
  Synthetic polypeptide
  MISC_FEATURE (1)..(7): X1 to X7 is repeated 86 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 86 - protein, 7 aa, Artificial Sequence
  Synthetic polypeptide
  MISC_FEATURE (1)..(7): X1 to X7 is repeated 87 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 87 - protein, 7 aa, Artificial Sequence
  Synthetic polypeptide
  MISC_FEATURE (1)..(7): X1 to X7 is repeated 88 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 88 - protein, 7 aa, Artificial Sequence
  Synthetic polypeptide
  MISC_FEATURE (1)..(7): X1 to X7 is repeated 89 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 89 - protein, 7 aa, Artificial Sequence
  Synthetic polypeptide
  MISC_FEATURE (1)..(7): X1 to X7 is repeated 90 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 90 - protein, 7 aa, Artificial Sequence
  Synthetic polypeptide
  MISC_FEATURE (1)..(7): X1 to X7 is repeated 91 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 91 - protein, 7 aa, Artificial Sequence
  Synthetic polypeptide
  MISC_FEATURE (1)..(7): X1 to X7 is repeated 92 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 92 - protein, 7 aa, Artificial Sequence
  Synthetic polypeptide
  MISC_FEATURE (1)..(7): X1 to X7 is repeated 93 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 93 - protein, 7 aa, Artificial Sequence
  Synthetic polypeptide
  MISC_FEATURE (1)..(7): X1 to X7 is repeated 94 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 94 - protein, 7 aa, Artificial Sequence
  Synthetic polypeptide
  MISC_FEATURE (1)..(7): X1 to X7 is repeated 95 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 95 - protein, 7 aa, Artificial Sequence
  Synthetic polypeptide
  MISC_FEATURE (1)..(7): X1 to X7 is repeated 96 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 96 - protein, 7 aa, Artificial Sequence
  Synthetic polypeptide
  MISC_FEATURE (1)..(7): X1 to X7 is repeated 97 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 97 - protein, 7 aa, Artificial Sequence
  Synthetic polypeptide
  MISC_FEATURE (1)..(7): X1 to X7 is repeated 98 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 98 - protein, 7 aa, Artificial Sequence
  Synthetic polypeptide
  MISC_FEATURE (1)..(7): X1 to X7 is repeated 99 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 99 - protein, 7 aa, Artificial Sequence
  Synthetic polypeptide
  MISC_FEATURE (1)..(7): X1 to X7 is repeated 100 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 100 - protein, 7 aa, Artificial Sequence
  Synthetic polypeptide
  MISC_FEATURE (1)..(7): X1 to X7 is repeated 101 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 101 - protein, 7 aa, Artificial Sequence
  Synthetic polypeptide
  MISC_FEATURE (1)..(7): X1 to X7 is repeated 102 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 102 - protein, 7 aa, Artificial Sequence
  Synthetic polypeptide
  MISC_FEATURE (1)..(7): X1 to X7 is repeated 103 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 103 - protein, 7 aa, Artificial Sequence
  Synthetic polypeptide
  MISC_FEATURE (1)..(7): X1 to X7 is repeated 104 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 104 - protein, 7 aa, Artificial Sequence
  Synthetic polypeptide
  MISC_FEATURE (1)..(7): X1 to X7 is repeated 105 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 105 - protein, 7 aa, Artificial Sequence
  Synthetic polypeptide
  MISC_FEATURE (1)..(7): X1 to X7 is repeated 106 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 106 - protein, 7 aa, Artificial Sequence
  Synthetic polypeptide
  MISC_FEATURE (1)..(7): X1 to X7 is repeated 107 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 107 - protein, 7 aa, Artificial Sequence
  Synthetic polypeptide
  MISC_FEATURE (1)..(7): X1 to X7 is repeated 108 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 108 - protein, 7 aa, Artificial Sequence
  Synthetic polypeptide
  MISC_FEATURE (1)..(7): X1 to X7 is repeated 109 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 109 - protein, 7 aa, Artificial Sequence
  Synthetic polypeptide
  MISC_FEATURE (1)..(7): X1 to X7 is repeated 110 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 110 - protein, 7 aa, Artificial Sequence
  Synthetic polypeptide
  MISC_FEATURE (1)..(7): X1 to X7 is repeated 111 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 111 - protein, 7 aa, Artificial Sequence
  Synthetic polypeptide
  MISC_FEATURE (1)..(7): X1 to X7 is repeated 112 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 112 - protein, 7 aa, Artificial Sequence
  Synthetic polypeptide
  MISC_FEATURE (1)..(7): X1 to X7 is repeated 113 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 113 - protein, 7 aa, Artificial Sequence
  Synthetic polypeptide
  MISC_FEATURE (1)..(7): X1 to X7 is repeated 114 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 114 - protein, 7 aa, Artificial Sequence
  Synthetic polypeptide
  MISC_FEATURE (1)..(7): X1 to X7 is repeated 115 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 115 - protein, 7 aa, Artificial Sequence
  Synthetic polypeptide
  MISC_FEATURE (1)..(7): X1 to X7 is repeated 116 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 116 - protein, 7 aa, Artificial Sequence
  Synthetic polypeptide
  MISC_FEATURE (1)..(7): X1 to X7 is repeated 117 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 117 - protein, 7 aa, Artificial Sequence
  Synthetic polypeptide
  MISC_FEATURE (1)..(7): X1 to X7 is repeated 118 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 118 - protein, 7 aa, Artificial Sequence
  Synthetic polypeptide
  MISC_FEATURE (1)..(7): X1 to X7 is repeated 119 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 119 - protein, 7 aa, Artificial Sequence
  Synthetic polypeptide
  MISC_FEATURE (1)..(7): X1 to X7 is repeated 120 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 120 - protein, 7 aa, Artificial Sequence
  Synthetic polypeptide
  MISC_FEATURE (1)..(7): X1 to X7 is repeated 121 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 121 - protein, 7 aa, Artificial Sequence
  Synthetic polypeptide
  MISC_FEATURE (1)..(7): X1 to X7 is repeated 122 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 122 - protein, 7 aa, Artificial Sequence
  Synthetic polypeptide
  MISC_FEATURE (1)..(7): X1 to X7 is repeated 123 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 123 - protein, 7 aa, Artificial Sequence
  Synthetic polypeptide
  MISC_FEATURE (1)..(7): X1 to X7 is repeated 124 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 124 - protein, 7 aa, Artificial Sequence
  Synthetic polypeptide
  MISC_FEATURE (1)..(7): X1 to X7 is repeated 125 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 125 - protein, 7 aa, Artificial Sequence
  Synthetic polypeptide
  MISC_FEATURE (1)..(7): X1 to X7 is repeated 126 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 126 - protein, 7 aa, Artificial Sequence
  Synthetic polypeptide
  MISC_FEATURE (1)..(7): X1 to X7 is repeated 127 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 127 - protein, 7 aa, Artificial Sequence
  Synthetic polypeptide
  MISC_FEATURE (1)..(7): X1 to X7 is repeated 128 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 128 - protein, 7 aa, Artificial Sequence
  Synthetic polypeptide
  MISC_FEATURE (1)..(7): X1 to X7 is repeated 129 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 129 - protein, 7 aa, Artificial Sequence
  Synthetic polypeptide
  MISC_FEATURE (1)..(7): X1 to X7 is repeated 130 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 130 - protein, 7 aa, Artificial Sequence
  Synthetic polypeptide
  MISC_FEATURE (1)..(7): X1 to X7 is repeated 131 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 131 - protein, 7 aa, Artificial Sequence
  Synthetic polypeptide
  MISC_FEATURE (1)..(7): X1 to X7 is repeated 132 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 132 - protein, 7 aa, Artificial Sequence
  Synthetic polypeptide
  MISC_FEATURE (1)..(7): X1 to X7 is repeated 133 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 133 - protein, 7 aa, Artificial Sequence
  Synthetic polypeptide
  MISC_FEATURE (1)..(7): X1 to X7 is repeated 134 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 134 - protein, 7 aa, Artificial Sequence
  Synthetic polypeptide
  MISC_FEATURE (1)..(7): X1 to X7 is repeated 135 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 135 - protein, 7 aa, Artificial Sequence
  Synthetic polypeptide
  MISC_FEATURE (1)..(7): X1 to X7 is repeated 136 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 136 - protein, 7 aa, Artificial Sequence
  Synthetic polypeptide
  MISC_FEATURE (1)..(7): X1 to X7 is repeated 137 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 137 - protein, 7 aa, Artificial Sequence
  Synthetic polypeptide
  MISC_FEATURE (1)..(7): X1 to X7 is repeated 138 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 138 - protein, 7 aa, Artificial Sequence
  Synthetic polypeptide
  MISC_FEATURE (1)..(7): X1 to X7 is repeated 139 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 139 - protein, 7 aa, Artificial Sequence
  Synthetic polypeptide
  MISC_FEATURE (1)..(7): X1 to X7 is repeated 140 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 140 - protein, 7 aa, Artificial Sequence
  Synthetic polypeptide
  MISC_FEATURE (1)..(7): X1 to X7 is repeated 141 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 141 - protein, 7 aa, Artificial Sequence
  Synthetic polypeptide
  MISC_FEATURE (1)..(7): X1 to X7 is repeated 142 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 142 - protein, 7 aa, Artificial Sequence
  Synthetic polypeptide
  MISC_FEATURE (1)..(7): X1 to X7 is repeated 143 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 143 - protein, 7 aa, Artificial Sequence
  Synthetic polypeptide
  MISC_FEATURE (1)..(7): X1 to X7 is repeated 144 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 144 - protein, 7 aa, Artificial Sequence
  Synthetic polypeptide
  MISC_FEATURE (1)..(7): X1 to X7 is repeated 145 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 145 - protein, 7 aa, Artificial Sequence
  Synthetic polypeptide
  MISC_FEATURE (1)..(7): X1 to X7 is repeated 146 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 146 - protein, 7 aa, Artificial Sequence
  Synthetic polypeptide
  MISC_FEATURE (1)..(7): X1 to X7 is repeated 147 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 147 - protein, 7 aa, Artificial Sequence
  Synthetic polypeptide
  MISC_FEATURE (1)..(7): X1 to X7 is repeated 148 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 148 - protein, 7 aa, Artificial Sequence
  Synthetic polypeptide
  MISC_FEATURE (1)..(7): X1 to X7 is repeated 149 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 149 - protein, 7 aa, Artificial Sequence
  Synthetic polypeptide
  MISC_FEATURE (1)..(7): X1 to X7 is repeated 150 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 150 - protein, 7 aa, Artificial Sequence
  Synthetic polypeptide
  MISC_FEATURE (1)..(7): X1 to X7 is repeated 151 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 151 - protein, 7 aa, Artificial Sequence
  Synthetic polypeptide
  MISC_FEATURE (1)..(7): X1 to X7 is repeated 152 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 152 - protein, 7 aa, Artificial Sequence
  Synthetic polypeptide
  MISC_FEATURE (1)..(7): X1 to X7 is repeated 153 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 153 - protein, 7 aa, Artificial Sequence
  Synthetic polypeptide
  MISC_FEATURE (1)..(7): X1 to X7 is repeated 154 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 154 - protein, 7 aa, Artificial Sequence
  Synthetic polypeptide
  MISC_FEATURE (1)..(7): X1 to X7 is repeated 155 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 155 - protein, 7 aa, Artificial Sequence
  Synthetic polypeptide
  MISC_FEATURE (1)..(7): X1 to X7 is repeated 156 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 156 - protein, 7 aa, Artificial Sequence
  Synthetic polypeptide
  MISC_FEATURE (1)..(7): X1 to X7 is repeated 157 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 157 - protein, 7 aa, Artificial Sequence
  Synthetic polypeptide
  MISC_FEATURE (1)..(7): X1 to X7 is repeated 158 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 158 - protein, 7 aa, Artificial Sequence
  Synthetic polypeptide
  MISC_FEATURE (1)..(7): X1 to X7 is repeated 159 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 159 - protein, 7 aa, Artificial Sequence
  Synthetic polypeptide
  MISC_FEATURE (1)..(7): X1 to X7 is repeated 160 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 160 - protein, 7 aa, Artificial Sequence
  Synthetic polypeptide
  MISC_FEATURE (1)..(7): X1 to X7 is repeated 161 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 161 - protein, 7 aa, Artificial Sequence
  Synthetic polypeptide
  MISC_FEATURE (1)..(7): X1 to X7 is repeated 162 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 162 - protein, 7 aa, Artificial Sequence
  Synthetic polypeptide
  MISC_FEATURE (1)..(7): X1 to X7 is repeated 163 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 163 - protein, 7 aa, Artificial Sequence
  Synthetic polypeptide
  MISC_FEATURE (1)..(7): X1 to X7 is repeated 164 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 164 - protein, 7 aa, Artificial Sequence
  Synthetic polypeptide
  MISC_FEATURE (1)..(7): X1 to X7 is repeated 165 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 165 - protein, 7 aa, Artificial Sequence
  Synthetic polypeptide
  MISC_FEATURE (1)..(7): X1 to X7 is repeated 166 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 166 - protein, 7 aa, Artificial Sequence
  Synthetic polypeptide
  MISC_FEATURE (1)..(7): X1 to X7 is repeated 167 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 167 - protein, 7 aa, Artificial Sequence
  Synthetic polypeptide
  MISC_FEATURE (1)..(7): X1 to X7 is repeated 168 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 168 - protein, 7 aa, Artificial Sequence
  Synthetic polypeptide
  MISC_FEATURE (1)..(7): X1 to X7 is repeated 169 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 169 - protein, 7 aa, Artificial Sequence
  Synthetic polypeptide
  MISC_FEATURE (1)..(7): X1 to X7 is repeated 170 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 170 - protein, 7 aa, Artificial Sequence
  Synthetic polypeptide
  MISC_FEATURE (1)..(7): X1 to X7 is repeated 171 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 171 - protein, 7 aa, Artificial Sequence
  Synthetic polypeptide
  MISC_FEATURE (1)..(7): X1 to X7 is repeated 172 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 172 - protein, 7 aa, Artificial Sequence
  Synthetic polypeptide
  MISC_FEATURE (1)..(7): X1 to X7 is repeated 173 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 173 - protein, 7 aa, Artificial Sequence
  Synthetic polypeptide
  MISC_FEATURE (1)..(7): X1 to X7 is repeated 174 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 174 - protein, 7 aa, Artificial Sequence
  Synthetic polypeptide
  MISC_FEATURE (1)..(7): X1 to X7 is repeated 175 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 175 - protein, 7 aa, Artificial Sequence
  Synthetic polypeptide
  MISC_FEATURE (1)..(7): X1 to X7 is repeated 176 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 176 - protein, 7 aa, Artificial Sequence
  Synthetic polypeptide
  MISC_FEATURE (1)..(7): X1 to X7 is repeated 177 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 177 - protein, 7 aa, Artificial Sequence
  Synthetic polypeptide
  MISC_FEATURE (1)..(7): X1 to X7 is repeated 178 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 178 - protein, 7 aa, Artificial Sequence
  Synthetic polypeptide
  MISC_FEATURE (1)..(7): X1 to X7 is repeated 179 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 179 - protein, 7 aa, Artificial Sequence
  Synthetic polypeptide
  MISC_FEATURE (1)..(7): X1 to X7 is repeated 180 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 180 - protein, 7 aa, Artificial Sequence
  Synthetic polypeptide
  MISC_FEATURE (1)..(7): X1 to X7 is repeated 181 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 181 - protein, 7 aa, Artificial Sequence
  Synthetic polypeptide
  MISC_FEATURE (1)..(7): X1 to X7 is repeated 182 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 182 - protein, 7 aa, Artificial Sequence
  Synthetic polypeptide
  MISC_FEATURE (1)..(7): X1 to X7 is repeated 183 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 183 - protein, 7 aa, Artificial Sequence
  Synthetic polypeptide
  MISC_FEATURE (1)..(7): X1 to X7 is repeated 184 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 184 - protein, 7 aa, Artificial Sequence
  Synthetic polypeptide
  MISC_FEATURE (1)..(7): X1 to X7 is repeated 185 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 185 - protein, 7 aa, Artificial Sequence
  Synthetic polypeptide
  MISC_FEATURE (1)..(7): X1 to X7 is repeated 186 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 186 - protein, 7 aa, Artificial Sequence
  Synthetic polypeptide
  MISC_FEATURE (1)..(7): X1 to X7 is repeated 187 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 187 - protein, 7 aa, Artificial Sequence
  Synthetic polypeptide
  MISC_FEATURE (1)..(7): X1 to X7 is repeated 188 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 188 - protein, 7 aa, Artificial Sequence
  Synthetic polypeptide
  MISC_FEATURE (1)..(7): X1 to X7 is repeated 189 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 189 - protein, 7 aa, Artificial Sequence
  Synthetic polypeptide
  MISC_FEATURE (1)..(7): X1 to X7 is repeated 190 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 190 - protein, 7 aa, Artificial Sequence
  Synthetic polypeptide
  MISC_FEATURE (1)..(7): X1 to X7 is repeated 191 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 191 - protein, 7 aa, Artificial Sequence
  Synthetic polypeptide
  MISC_FEATURE (1)..(7): X1 to X7 is repeated 192 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 192 - protein, 7 aa, Artificial Sequence
  Synthetic polypeptide
  MISC_FEATURE (1)..(7): X1 to X7 is repeated 193 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 193 - protein, 7 aa, Artificial Sequence
  Synthetic polypeptide
  MISC_FEATURE (1)..(7): X1 to X7 is repeated 194 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 194 - protein, 7 aa, Artificial Sequence
  Synthetic polypeptide
  MISC_FEATURE (1)..(7): X1 to X7 is repeated 195 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 195 - protein, 7 aa, Artificial Sequence
  Synthetic polypeptide
  MISC_FEATURE (1)..(7): X1 to X7 is repeated 196 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 196 - protein, 7 aa, Artificial Sequence
  Synthetic polypeptide
  MISC_FEATURE (1)..(7): X1 to X7 is repeated 197 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 197 - protein, 7 aa, Artificial Sequence
  Synthetic polypeptide
  MISC_FEATURE (1)..(7): X1 to X7 is repeated 198 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 198 - protein, 7 aa, Artificial Sequence
  Synthetic polypeptide
  MISC_FEATURE (1)..(7): X1 to X7 is repeated 199 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 199 - protein, 7 aa, Artificial Sequence
  Synthetic polypeptide
  MISC_FEATURE (1)..(7): X1 to X7 is repeated 200 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 200 - protein, 7 aa, Artificial Sequence
  Synthetic polypeptide
  MISC_FEATURE (1)..(7): X1 to X7 is repeated 201 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 201 - protein, 7 aa, Artificial Sequence
  Synthetic polypeptide
  MISC_FEATURE (1)..(7): X1 to X7 is repeated 202 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 202 - protein, 7 aa, Artificial Sequence
  Synthetic polypeptide
  MISC_FEATURE (1)..(7): X1 to X7 is repeated 203 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 203 - protein, 7 aa, Artificial Sequence
  Synthetic polypeptide
  MISC_FEATURE (1)..(7): X1 to X7 is repeated 204 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 204 - protein, 7 aa, Artificial Sequence
  Synthetic polypeptide
  MISC_FEATURE (1)..(7): X1 to X7 is repeated 205 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 205 - protein, 7 aa, Artificial Sequence
  Synthetic polypeptide
  MISC_FEATURE (1)..(7): X1 to X7 is repeated 206 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 206 - protein, 7 aa, Artificial Sequence
  Synthetic polypeptide
  MISC_FEATURE (1)..(7): X1 to X7 is repeated 207 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 207 - protein, 7 aa, Artificial Sequence
  Synthetic polypeptide
  MISC_FEATURE (1)..(7): X1 to X7 is repeated 208 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 208 - protein, 7 aa, Artificial Sequence
  Synthetic polypeptide
  MISC_FEATURE (1)..(7): X1 to X7 is repeated 209 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 209 - protein, 7 aa, Artificial Sequence
  Synthetic polypeptide
  MISC_FEATURE (1)..(7): X1 to X7 is repeated 210 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 210 - protein, 7 aa, Artificial Sequence
  Synthetic polypeptide
  MISC_FEATURE (1)..(7): X1 to X7 is repeated 211 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 211 - protein, 7 aa, Artificial Sequence
  Synthetic polypeptide
  MISC_FEATURE (1)..(7): X1 to X7 is repeated 212 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 212 - protein, 7 aa, Artificial Sequence
  Synthetic polypeptide
  MISC_FEATURE (1)..(7): X1 to X7 is repeated 213 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 213 - protein, 7 aa, Artificial Sequence
  Synthetic polypeptide
  MISC_FEATURE (1)..(7): X1 to X7 is repeated 214 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 214 - protein, 7 aa, Artificial Sequence
  Synthetic polypeptide
  MISC_FEATURE (1)..(7): X1 to X7 is repeated 215 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 215 - protein, 7 aa, Artificial Sequence
  Synthetic polypeptide
  MISC_FEATURE (1)..(7): X1 to X7 is repeated 216 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 216 - protein, 7 aa, Artificial Sequence
  Synthetic polypeptide
  MISC_FEATURE (1)..(7): X1 to X7 is repeated 217 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 217 - protein, 7 aa, Artificial Sequence
  Synthetic polypeptide
  MISC_FEATURE (1)..(7): X1 to X7 is repeated 218 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 218 - protein, 7 aa, Artificial Sequence
  Synthetic polypeptide
  MISC_FEATURE (1)..(7): X1 to X7 is repeated 219 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 219 - protein, 7 aa, Artificial Sequence
  Synthetic polypeptide
  MISC_FEATURE (1)..(7): X1 to X7 is repeated 220 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 220 - protein, 7 aa, Artificial Sequence
  Synthetic polypeptide
  MISC_FEATURE (1)..(7): X1 to X7 is repeated 221 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 221 - protein, 7 aa, Artificial Sequence
  Synthetic polypeptide
  MISC_FEATURE (1)..(7): X1 to X7 is repeated 222 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 222 - protein, 7 aa, Artificial Sequence
  Synthetic polypeptide
  MISC_FEATURE (1)..(7): X1 to X7 is repeated 223 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 223 - protein, 7 aa, Artificial Sequence
  Synthetic polypeptide
  MISC_FEATURE (1)..(7): X1 to X7 is repeated 224 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 224 - protein, 7 aa, Artificial Sequence
  Synthetic polypeptide
  MISC_FEATURE (1)..(7): X1 to X7 is repeated 225 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 225 - protein, 7 aa, Artificial Sequence
  Synthetic polypeptide
  MISC_FEATURE (1)..(7): X1 to X7 is repeated 226 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 226 - protein, 7 aa, Artificial Sequence
  Synthetic polypeptide
  MISC_FEATURE (1)..(7): X1 to X7 is repeated 227 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 227 - protein, 7 aa, Artificial Sequence
  Synthetic polypeptide
  MISC_FEATURE (1)..(7): X1 to X7 is repeated 228 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 228 - protein, 7 aa, Artificial Sequence
  Synthetic polypeptide
  MISC_FEATURE (1)..(7): X1 to X7 is repeated 229 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 229 - protein, 7 aa, Artificial Sequence
  Synthetic polypeptide
  MISC_FEATURE (1)..(7): X1 to X7 is repeated 230 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 230 - protein, 7 aa, Artificial Sequence
  Synthetic polypeptide
  MISC_FEATURE (1)..(7): X1 to X7 is repeated 231 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 231 - protein, 7 aa, Artificial Sequence
  Synthetic polypeptide
  MISC_FEATURE (1)..(7): X1 to X7 is repeated 232 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 232 - protein, 7 aa, Artificial Sequence
  Synthetic polypeptide
  MISC_FEATURE (1)..(7): X1 to X7 is repeated 233 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 233 - protein, 7 aa, Artificial Sequence
  Synthetic polypeptide
  MISC_FEATURE (1)..(7): X1 to X7 is repeated 234 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 234 - protein, 7 aa, Artificial Sequence
  Synthetic polypeptide
  MISC_FEATURE (1)..(7): X1 to X7 is repeated 235 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 235 - protein, 7 aa, Artificial Sequence
  Synthetic polypeptide
  MISC_FEATURE (1)..(7): X1 to X7 is repeated 236 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 236 - protein, 7 aa, Artificial Sequence
  Synthetic polypeptide
  MISC_FEATURE (1)..(7): X1 to X7 is repeated 237 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 237 - protein, 7 aa, Artificial Sequence
  Synthetic polypeptide
  MISC_FEATURE (1)..(7): X1 to X7 is repeated 238 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 238 - protein, 7 aa, Artificial Sequence
  Synthetic polypeptide
  MISC_FEATURE (1)..(7): X1 to X7 is repeated 239 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 239 - protein, 7 aa, Artificial Sequence
  Synthetic polypeptide
  MISC_FEATURE (1)..(7): X1 to X7 is repeated 240 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 240 - protein, 7 aa, Artificial Sequence
  Synthetic polypeptide
  MISC_FEATURE (1)..(7): X1 to X7 is repeated 241 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 241 - protein, 7 aa, Artificial Sequence
  Synthetic polypeptide
  MISC_FEATURE (1)..(7): X1 to X7 is repeated 242 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 242 - protein, 7 aa, Artificial Sequence
  Synthetic polypeptide
  MISC_FEATURE (1)..(7): X1 to X7 is repeated 243 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 243 - protein, 7 aa, Artificial Sequence
  Synthetic polypeptide
  MISC_FEATURE (1)..(7): X1 to X7 is repeated 244 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 244 - protein, 7 aa, Artificial Sequence
  Synthetic polypeptide
  MISC_FEATURE (1)..(7): X1 to X7 is repeated 245 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 245 - protein, 7 aa, Artificial Sequence
  Synthetic polypeptide
  MISC_FEATURE (1)..(7): X1 to X7 is repeated 246 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 246 - protein, 7 aa, Artificial Sequence
  Synthetic polypeptide
  MISC_FEATURE (1)..(7): X1 to X7 is repeated 247 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 247 - protein, 7 aa, Artificial Sequence
  Synthetic polypeptide
  MISC_FEATURE (1)..(7): X1 to X7 is repeated 248 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 248 - protein, 7 aa, Artificial Sequence
  Synthetic polypeptide
  MISC_FEATURE (1)..(7): X1 to X7 is repeated 249 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 249 - protein, 7 aa, Artificial Sequence
  Synthetic polypeptide
  MISC_FEATURE (1)..(7): X1 to X7 is repeated 250 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 250 - protein, 7 aa, Artificial Sequence
  Synthetic polypeptide
  MISC_FEATURE (1)..(7): X1 to X7 is repeated 251 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 251 - protein, 7 aa, Artificial Sequence
  Synthetic polypeptide
  MISC_FEATURE (1)..(7): X1 to X7 is repeated 252 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 252 - protein, 7 aa, Artificial Sequence
  Synthetic polypeptide
  MISC_FEATURE (1)..(7): X1 to X7 is repeated 253 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 253 - protein, 7 aa, Artificial Sequence
  Synthetic polypeptide
  MISC_FEATURE (1)..(7): X1 to X7 is repeated 254 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 254 - protein, 7 aa, Artificial Sequence
  Synthetic polypeptide
  MISC_FEATURE (1)..(7): X1 to X7 is repeated 255 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 255 - protein, 7 aa, Artificial Sequence
  Synthetic polypeptide
  MISC_FEATURE (1)..(7): X1 to X7 is repeated 256 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 256 - protein, 7 aa, Artificial Sequence
  Synthetic polypeptide
  MISC_FEATURE (1)..(7): X1 to X7 is repeated 257 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 257 - protein, 7 aa, Artificial Sequence
  Synthetic polypeptide
  MISC_FEATURE (1)..(7): X1 to X7 is repeated 258 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 258 - protein, 7 aa, Artificial Sequence
  Synthetic polypeptide
  MISC_FEATURE (1)..(7): X1 to X7 is repeated 259 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 259 - protein, 7 aa, Artificial Sequence
  Synthetic polypeptide
  MISC_FEATURE (1)..(7): X1 to X7 is repeated 260 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 260 - protein, 7 aa, Artificial Sequence
  Synthetic polypeptide
  MISC_FEATURE (1)..(7): X1 to X7 is repeated 261 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 261 - protein, 7 aa, Artificial Sequence
  Synthetic polypeptide
  MISC_FEATURE (1)..(7): X1 to X7 is repeated 262 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 262 - protein, 7 aa, Artificial Sequence
  Synthetic polypeptide
  MISC_FEATURE (1)..(7): X1 to X7 is repeated 263 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 263 - protein, 7 aa, Artificial Sequence
  Synthetic polypeptide
  MISC_FEATURE (1)..(7): X1 to X7 is repeated 264 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 264 - protein, 7 aa, Artificial Sequence
  Synthetic polypeptide
  MISC_FEATURE (1)..(7): X1 to X7 is repeated 265 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 265 - protein, 7 aa, Artificial Sequence
  Synthetic polypeptide
  MISC_FEATURE (1)..(7): X1 to X7 is repeated 266 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 266 - protein, 7 aa, Artificial Sequence
  Synthetic polypeptide
  MISC_FEATURE (1)..(7): X1 to X7 is repeated 267 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 267 - protein, 7 aa, Artificial Sequence
  Synthetic polypeptide
  MISC_FEATURE (1)..(7): X1 to X7 is repeated 268 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 268 - protein, 7 aa, Artificial Sequence
  Synthetic polypeptide
  MISC_FEATURE (1)..(7): X1 to X7 is repeated 269 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 269 - protein, 7 aa, Artificial Sequence
  Synthetic polypeptide
  MISC_FEATURE (1)..(7): X1 to X7 is repeated 270 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 270 - protein, 7 aa, Artificial Sequence
  Synthetic polypeptide
  MISC_FEATURE (1)..(7): X1 to X7 is repeated 271 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 271 - protein, 7 aa, Artificial Sequence
  Synthetic polypeptide
  MISC_FEATURE (1)..(7): X1 to X7 is repeated 272 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 272 - protein, 7 aa, Artificial Sequence
  Synthetic polypeptide
  MISC_FEATURE (1)..(7): X1 to X7 is repeated 273 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 273 - protein, 7 aa, Artificial Sequence
  Synthetic polypeptide
  MISC_FEATURE (1)..(7): X1 to X7 is repeated 274 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 274 - protein, 7 aa, Artificial Sequence
  Synthetic polypeptide
  MISC_FEATURE (1)..(7): X1 to X7 is repeated 275 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 275 - protein, 7 aa, Artificial Sequence
  Synthetic polypeptide
  MISC_FEATURE (1)..(7): X1 to X7 is repeated 276 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 276 - protein, 7 aa, Artificial Sequence
  Synthetic polypeptide
  MISC_FEATURE (1)..(7): X1 to X7 is repeated 277 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 277 - protein, 7 aa, Artificial Sequence
  Synthetic polypeptide
  MISC_FEATURE (1)..(7): X1 to X7 is repeated 278 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 278 - protein, 7 aa, Artificial Sequence
  Synthetic polypeptide
  MISC_FEATURE (1)..(7): X1 to X7 is repeated 279 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 279 - protein, 7 aa, Artificial Sequence
  Synthetic polypeptide
  MISC_FEATURE (1)..(7): X1 to X7 is repeated 280 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 280 - protein, 7 aa, Artificial Sequence
  Synthetic polypeptide
  MISC_FEATURE (1)..(7): X1 to X7 is repeated 281 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 281 - protein, 7 aa, Artificial Sequence
  Synthetic polypeptide
  MISC_FEATURE (1)..(7): X1 to X7 is repeated 282 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 282 - protein, 7 aa, Artificial Sequence
  Synthetic polypeptide
  MISC_FEATURE (1)..(7): X1 to X7 is repeated 283 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 283 - protein, 7 aa, Artificial Sequence
  Synthetic polypeptide
  MISC_FEATURE (1)..(7): X1 to X7 is repeated 284 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 284 - protein, 7 aa, Artificial Sequence
  Synthetic polypeptide
  MISC_FEATURE (1)..(7): X1 to X7 is repeated 285 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 285 - protein, 7 aa, Artificial Sequence
  Synthetic polypeptide
  MISC_FEATURE (1)..(7): X1 to X7 is repeated 286 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 286 - protein, 7 aa, Artificial Sequence
  Synthetic polypeptide
  MISC_FEATURE (1)..(7): X1 to X7 is repeated 287 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 287 - protein, 7 aa, Artificial Sequence
  Synthetic polypeptide
  MISC_FEATURE (1)..(7): X1 to X7 is repeated 288 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 288 - protein, 7 aa, Artificial Sequence
  Synthetic polypeptide
  MISC_FEATURE (1)..(7): X1 to X7 is repeated 289 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 289 - protein, 7 aa, Artificial Sequence
  Synthetic polypeptide
  MISC_FEATURE (1)..(7): X1 to X7 is repeated 290 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 290 - protein, 7 aa, Artificial Sequence
  Synthetic polypeptide
  MISC_FEATURE (1)..(7): X1 to X7 is repeated 291 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 291 - protein, 7 aa, Artificial Sequence
  Synthetic polypeptide
  MISC_FEATURE (1)..(7): X1 to X7 is repeated 292 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 292 - protein, 7 aa, Artificial Sequence
  Synthetic polypeptide
  MISC_FEATURE (1)..(7): X1 to X7 is repeated 293 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 293 - protein, 7 aa, Artificial Sequence
  Synthetic polypeptide
  MISC_FEATURE (1)..(7): X1 to X7 is repeated 294 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 294 - protein, 7 aa, Artificial Sequence
  Synthetic polypeptide
  MISC_FEATURE (1)..(7): X1 to X7 is repeated 295 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 295 - protein, 7 aa, Artificial Sequence
  Synthetic polypeptide
  MISC_FEATURE (1)..(7): X1 to X7 is repeated 296 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 296 - protein, 7 aa, Artificial Sequence
  Synthetic polypeptide
  MISC_FEATURE (1)..(7): X1 to X7 is repeated 297 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 297 - protein, 7 aa, Artificial Sequence
  Synthetic polypeptide
  MISC_FEATURE (1)..(7): X1 to X7 is repeated 298 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 298 - protein, 7 aa, Artificial Sequence
  Synthetic polypeptide
  MISC_FEATURE (1)..(7): X1 to X7 is repeated 299 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 299 - protein, 7 aa, Artificial Sequence
  Synthetic polypeptide
  MISC_FEATURE (1)..(7): X1 to X7 is repeated 300 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 300 - protein, 7 aa, Artificial Sequence
  Synthetic polypeptide
  MISC_FEATURE (1)..(7): X1 to X7 is repeated 301 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 301 - protein, 7 aa, Artificial Sequence
  Synthetic polypeptide
  MISC_FEATURE (1)..(7): X1 to X7 is repeated 302 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 302 - protein, 7 aa, Artificial Sequence
  Synthetic polypeptide
  MISC_FEATURE (1)..(7): X1 to X7 is repeated 303 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 303 - protein, 7 aa, Artificial Sequence
  Synthetic polypeptide
  MISC_FEATURE (1)..(7): X1 to X7 is repeated 304 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 304 - protein, 7 aa, Artificial Sequence
  Synthetic polypeptide
  MISC_FEATURE (1)..(7): X1 to X7 is repeated 305 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 305 - protein, 7 aa, Artificial Sequence
  Synthetic polypeptide
  MISC_FEATURE (1)..(7): X1 to X7 is repeated 306 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 306 - protein, 7 aa, Artificial Sequence
  Synthetic polypeptide
  MISC_FEATURE (1)..(7): X1 to X7 is repeated 307 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 307 - protein, 7 aa, Artificial Sequence
  Synthetic polypeptide
  MISC_FEATURE (1)..(7): X1 to X7 is repeated 308 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 308 - protein, 7 aa, Artificial Sequence
  Synthetic polypeptide
  MISC_FEATURE (1)..(7): X1 to X7 is repeated 309 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 309 - protein, 7 aa, Artificial Sequence
  Synthetic polypeptide
  MISC_FEATURE (1)..(7): X1 to X7 is repeated 310 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 310 - protein, 7 aa, Artificial Sequence
  Synthetic polypeptide
  MISC_FEATURE (1)..(7): X1 to X7 is repeated 311 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 311 - protein, 7 aa, Artificial Sequence
  Synthetic polypeptide
  MISC_FEATURE (1)..(7): X1 to X7 is repeated 312 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 312 - protein, 7 aa, Artificial Sequence
  Synthetic polypeptide
  MISC_FEATURE (1)..(7): X1 to X7 is repeated 313 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 313 - protein, 7 aa, Artificial Sequence
  Synthetic polypeptide
  MISC_FEATURE (1)..(7): X1 to X7 is repeated 314 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 314 - protein, 7 aa, Artificial Sequence
  Synthetic polypeptide
  MISC_FEATURE (1)..(7): X1 to X7 is repeated 315 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 315 - protein, 7 aa, Artificial Sequence
  Synthetic polypeptide
  MISC_FEATURE (1)..(7): X1 to X7 is repeated 316 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 316 - protein, 7 aa, Artificial Sequence
  Synthetic polypeptide
  MISC_FEATURE (1)..(7): X1 to X7 is repeated 317 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 317 - protein, 7 aa, Artificial Sequence
  Synthetic polypeptide
  MISC_FEATURE (1)..(7): X1 to X7 is repeated 318 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 318 - protein, 7 aa, Artificial Sequence
  Synthetic polypeptide
  MISC_FEATURE (1)..(7): X1 to X7 is repeated 319 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 319 - protein, 7 aa, Artificial Sequence
  Synthetic polypeptide
  MISC_FEATURE (1)..(7): X1 to X7 is repeated 320 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 320 - protein, 7 aa, Artificial Sequence
  Synthetic polypeptide
  MISC_FEATURE (1)..(7): X1 to X7 is repeated 321 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 321 - protein, 7 aa, Artificial Sequence
  Synthetic polypeptide
  MISC_FEATURE (1)..(7): X1 to X7 is repeated 322 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 322 - protein, 7 aa, Artificial Sequence
  Synthetic polypeptide
  MISC_FEATURE (1)..(7): X1 to X7 is repeated 323 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 323 - protein, 7 aa, Artificial Sequence
  Synthetic polypeptide
  MISC_FEATURE (1)..(7): X1 to X7 is repeated 324 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 324 - protein, 7 aa, Artificial Sequence
  Synthetic polypeptide
  MISC_FEATURE (1)..(7): X1 to X7 is repeated 325 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 325 - protein, 7 aa, Artificial Sequence
  Synthetic polypeptide
  MISC_FEATURE (1)..(7): X1 to X7 is repeated 326 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 326 - protein, 7 aa, Artificial Sequence
  Synthetic polypeptide
  MISC_FEATURE (1)..(7): X1 to X7 is repeated 327 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 327 - protein, 7 aa, Artificial Sequence
  Synthetic polypeptide
  MISC_FEATURE (1)..(7): X1 to X7 is repeated 328 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 328 - protein, 7 aa, Artificial Sequence
  Synthetic polypeptide
  MISC_FEATURE (1)..(7): X1 to X7 is repeated 329 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 329 - protein, 7 aa, Artificial Sequence
  Synthetic polypeptide
  MISC_FEATURE (1)..(7): X1 to X7 is repeated 330 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 330 - protein, 7 aa, Artificial Sequence
  Synthetic polypeptide
  MISC_FEATURE (1)..(7): X1 to X7 is repeated 331 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 331 - protein, 7 aa, Artificial Sequence
  Synthetic polypeptide
  MISC_FEATURE (1)..(7): X1 to X7 is repeated 332 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 332 - protein, 7 aa, Artificial Sequence
  Synthetic polypeptide
  MISC_FEATURE (1)..(7): X1 to X7 is repeated 333 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 333 - protein, 7 aa, Artificial Sequence
  Synthetic polypeptide
  MISC_FEATURE (1)..(7): X1 to X7 is repeated 334 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 334 - protein, 7 aa, Artificial Sequence
  Synthetic polypeptide
  MISC_FEATURE (1)..(7): X1 to X7 is repeated 335 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 335 - protein, 7 aa, Artificial Sequence
  Synthetic polypeptide
  MISC_FEATURE (1)..(7): X1 to X7 is repeated 336 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 336 - protein, 7 aa, Artificial Sequence
  Synthetic polypeptide
  MISC_FEATURE (1)..(7): X1 to X7 is repeated 337 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 337 - protein, 7 aa, Artificial Sequence
  Synthetic polypeptide
  MISC_FEATURE (1)..(7): X1 to X7 is repeated 338 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 338 - protein, 7 aa, Artificial Sequence
  Synthetic polypeptide
  MISC_FEATURE (1)..(7): X1 to X7 is repeated 339 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 339 - protein, 7 aa, Artificial Sequence
  Synthetic polypeptide
  MISC_FEATURE (1)..(7): X1 to X7 is repeated 340 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 340 - protein, 7 aa, Artificial Sequence
  Synthetic polypeptide
  MISC_FEATURE (1)..(7): X1 to X7 is repeated 341 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 341 - protein, 7 aa, Artificial Sequence
  Synthetic polypeptide
  MISC_FEATURE (1)..(7): X1 to X7 is repeated 342 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 342 - protein, 7 aa, Artificial Sequence
  Synthetic polypeptide
  MISC_FEATURE (1)..(7): X1 to X7 is repeated 343 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 343 - protein, 7 aa, Artificial Sequence
  Synthetic polypeptide
  MISC_FEATURE (1)..(7): X1 to X7 is repeated 344 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 344 - protein, 7 aa, Artificial Sequence
  Synthetic polypeptide
  MISC_FEATURE (1)..(7): X1 to X7 is repeated 345 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 345 - protein, 7 aa, Artificial Sequence
  Synthetic polypeptide
  MISC_FEATURE (1)..(7): X1 to X7 is repeated 346 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 346 - protein, 7 aa, Artificial Sequence
  Synthetic polypeptide
  MISC_FEATURE (1)..(7): X1 to X7 is repeated 347 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 347 - protein, 7 aa, Artificial Sequence
  Synthetic polypeptide
  MISC_FEATURE (1)..(7): X1 to X7 is repeated 348 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 348 - protein, 7 aa, Artificial Sequence
  Synthetic polypeptide
  MISC_FEATURE (1)..(7): X1 to X7 is repeated 349 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 349 - protein, 7 aa, Artificial Sequence
  Synthetic polypeptide
  MISC_FEATURE (1)..(7): X1 to X7 is repeated 350 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 350 - protein, 7 aa, Artificial Sequence
  Synthetic polypeptide
  MISC_FEATURE (1)..(7): X1 to X7 is repeated 351 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 351 - protein, 7 aa, Artificial Sequence
  Synthetic polypeptide
  MISC_FEATURE (1)..(7): X1 to X7 is repeated 352 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 352 - protein, 7 aa, Artificial Sequence
  Synthetic polypeptide
  MISC_FEATURE (1)..(7): X1 to X7 is repeated 353 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 353 - protein, 7 aa, Artificial Sequence
  Synthetic polypeptide
  MISC_FEATURE (1)..(7): X1 to X7 is repeated 354 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 354 - protein, 7 aa, Artificial Sequence
  Synthetic polypeptide
  MISC_FEATURE (1)..(7): X1 to X7 is repeated 355 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 355 - protein, 7 aa, Artificial Sequence
  Synthetic polypeptide
  MISC_FEATURE (1)..(7): X1 to X7 is repeated 356 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 356 - protein, 7 aa, Artificial Sequence
  Synthetic polypeptide
  MISC_FEATURE (1)..(7): X1 to X7 is repeated 357 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 357 - protein, 7 aa, Artificial Sequence
  Synthetic polypeptide
  MISC_FEATURE (1)..(7): X1 to X7 is repeated 358 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 358 - protein, 7 aa, Artificial Sequence
  Synthetic polypeptide
  MISC_FEATURE (1)..(7): X1 to X7 is repeated 359 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 359 - protein, 7 aa, Artificial Sequence
  Synthetic polypeptide
  MISC_FEATURE (1)..(7): X1 to X7 is repeated 360 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 360 - protein, 7 aa, Artificial Sequence
  Synthetic polypeptide
  MISC_FEATURE (1)..(7): X1 to X7 is repeated 361 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 361 - protein, 7 aa, Artificial Sequence
  Synthetic polypeptide
  MISC_FEATURE (1)..(7): X1 to X7 is repeated 362 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 362 - protein, 7 aa, Artificial Sequence
  Synthetic polypeptide
  MISC_FEATURE (1)..(7): X1 to X7 is repeated 363 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 363 - protein, 7 aa, Artificial Sequence
  Synthetic polypeptide
  MISC_FEATURE (1)..(7): X1 to X7 is repeated 364 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 364 - protein, 7 aa, Artificial Sequence
  Synthetic polypeptide
  MISC_FEATURE (1)..(7): X1 to X7 is repeated 365 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 365 - protein, 7 aa, Artificial Sequence
  Synthetic polypeptide
  MISC_FEATURE (1)..(7): X1 to X7 is repeated 366 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 366 - protein, 7 aa, Artificial Sequence
  Synthetic polypeptide
  MISC_FEATURE (1)..(7): X1 to X7 is repeated 367 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 367 - protein, 7 aa, Artificial Sequence
  Synthetic polypeptide
  MISC_FEATURE (1)..(7): X1 to X7 is repeated 368 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 368 - protein, 7 aa, Artificial Sequence
  Synthetic polypeptide
  MISC_FEATURE (1)..(7): X1 to X7 is repeated 369 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 369 - protein, 7 aa, Artificial Sequence
  Synthetic polypeptide
  MISC_FEATURE (1)..(7): X1 to X7 is repeated 370 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 370 - protein, 7 aa, Artificial Sequence
  Synthetic polypeptide
  MISC_FEATURE (1)..(7): X1 to X7 is repeated 371 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 371 - protein, 7 aa, Artificial Sequence
  Synthetic polypeptide
  MISC_FEATURE (1)..(7): X1 to X7 is repeated 372 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 372 - protein, 7 aa, Artificial Sequence
  Synthetic polypeptide
  MISC_FEATURE (1)..(7): X1 to X7 is repeated 373 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 373 - protein, 7 aa, Artificial Sequence
  Synthetic polypeptide
  MISC_FEATURE (1)..(7): X1 to X7 is repeated 374 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 374 - protein, 7 aa, Artificial Sequence
  Synthetic polypeptide
  MISC_FEATURE (1)..(7): X1 to X7 is repeated 375 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 375 - protein, 7 aa, Artificial Sequence
  Synthetic polypeptide
  MISC_FEATURE (1)..(7): X1 to X7 is repeated 376 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 376 - protein, 7 aa, Artificial Sequence
  Synthetic polypeptide
  MISC_FEATURE (1)..(7): X1 to X7 is repeated 377 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 377 - protein, 7 aa, Artificial Sequence
  Synthetic polypeptide
  MISC_FEATURE (1)..(7): X1 to X7 is repeated 378 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 378 - protein, 7 aa, Artificial Sequence
  Synthetic polypeptide
  MISC_FEATURE (1)..(7): X1 to X7 is repeated 379 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 379 - protein, 7 aa, Artificial Sequence
  Synthetic polypeptide
  MISC_FEATURE (1)..(7): X1 to X7 is repeated 380 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 380 - protein, 7 aa, Artificial Sequence
  Synthetic polypeptide
  MISC_FEATURE (1)..(7): X1 to X7 is repeated 381 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 381 - protein, 7 aa, Artificial Sequence
  Synthetic polypeptide
  MISC_FEATURE (1)..(7): X1 to X7 is repeated 382 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 382 - protein, 7 aa, Artificial Sequence
  Synthetic polypeptide
  MISC_FEATURE (1)..(7): X1 to X7 is repeated 383 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 383 - protein, 7 aa, Artificial Sequence
  Synthetic polypeptide
  MISC_FEATURE (1)..(7): X1 to X7 is repeated 384 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 384 - protein, 7 aa, Artificial Sequence
  Synthetic polypeptide
  MISC_FEATURE (1)..(7): X1 to X7 is repeated 385 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 385 - protein, 7 aa, Artificial Sequence
  Synthetic polypeptide
  MISC_FEATURE (1)..(7): X1 to X7 is repeated 386 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 386 - protein, 7 aa, Artificial Sequence
  Synthetic polypeptide
  MISC_FEATURE (1)..(7): X1 to X7 is repeated 387 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 387 - protein, 7 aa, Artificial Sequence
  Synthetic polypeptide
  MISC_FEATURE (1)..(7): X1 to X7 is repeated 388 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 388 - protein, 7 aa, Artificial Sequence
  Synthetic polypeptide
  MISC_FEATURE (1)..(7): X1 to X7 is repeated 389 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 389 - protein, 7 aa, Artificial Sequence
  Synthetic polypeptide
  MISC_FEATURE (1)..(7): X1 to X7 is repeated 390 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 390 - protein, 7 aa, Artificial Sequence
  Synthetic polypeptide
  MISC_FEATURE (1)..(7): X1 to X7 is repeated 391 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 391 - protein, 7 aa, Artificial Sequence
  Synthetic polypeptide
  MISC_FEATURE (1)..(7): X1 to X7 is repeated 392 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 392 - protein, 7 aa, Artificial Sequence
  Synthetic polypeptide
  MISC_FEATURE (1)..(7): X1 to X7 is repeated 393 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 393 - protein, 7 aa, Artificial Sequence
  Synthetic polypeptide
  MISC_FEATURE (1)..(7): X1 to X7 is repeated 394 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 394 - protein, 7 aa, Artificial Sequence
  Synthetic polypeptide
  MISC_FEATURE (1)..(7): X1 to X7 is repeated 395 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 395 - protein, 7 aa, Artificial Sequence
  Synthetic polypeptide
  MISC_FEATURE (1)..(7): X1 to X7 is repeated 396 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 396 - protein, 7 aa, Artificial Sequence
  Synthetic polypeptide
  MISC_FEATURE (1)..(7): X1 to X7 is repeated 397 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 397 - protein, 7 aa, Artificial Sequence
  Synthetic polypeptide
  MISC_FEATURE (1)..(7): X1 to X7 is repeated 398 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 398 - protein, 7 aa, Artificial Sequence
  Synthetic polypeptide
  MISC_FEATURE (1)..(7): X1 to X7 is repeated 399 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 399 - protein, 7 aa, Artificial Sequence
  Synthetic polypeptide
  MISC_FEATURE (1)..(7): X1 to X7 is repeated 400 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 400 - protein, 7 aa, Artificial Sequence
  Synthetic polypeptide
  MISC_FEATURE (1)..(7): X1 to X7 is repeated 401 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 401 - protein, 7 aa, Artificial Sequence
  Synthetic polypeptide
  MISC_FEATURE (1)..(7): X1 to X7 is repeated 402 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 402 - protein, 7 aa, Artificial Sequence
  Synthetic polypeptide
  MISC_FEATURE (1)..(7): X1 to X7 is repeated 403 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 403 - protein, 7 aa, Artificial Sequence
  Synthetic polypeptide
  MISC_FEATURE (1)..(7): X1 to X7 is repeated 404 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 404 - protein, 7 aa, Artificial Sequence
  Synthetic polypeptide
  MISC_FEATURE (1)..(7): X1 to X7 is repeated 405 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 405 - protein, 7 aa, Artificial Sequence
  Synthetic polypeptide
  MISC_FEATURE (1)..(7): X1 to X7 is repeated 406 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 406 - protein, 7 aa, Artificial Sequence
  Synthetic polypeptide
  MISC_FEATURE (1)..(7): X1 to X7 is repeated 407 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 407 - protein, 7 aa, Artificial Sequence
  Synthetic polypeptide
  MISC_FEATURE (1)..(7): X1 to X7 is repeated 408 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 408 - protein, 7 aa, Artificial Sequence
  Synthetic polypeptide
  MISC_FEATURE (1)..(7): X1 to X7 is repeated 409 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 409 - protein, 7 aa, Artificial Sequence
  Synthetic polypeptide
  MISC_FEATURE (1)..(7): X1 to X7 is repeated 410 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 410 - protein, 7 aa, Artificial Sequence
  Synthetic polypeptide
  MISC_FEATURE (1)..(7): X1 to X7 is repeated 411 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 411 - protein, 7 aa, Artificial Sequence
  Synthetic polypeptide
  MISC_FEATURE (1)..(7): X1 to X7 is repeated 412 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 412 - protein, 7 aa, Artificial Sequence
  Synthetic polypeptide
  MISC_FEATURE (1)..(7): X1 to X7 is repeated 413 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 413 - protein, 7 aa, Artificial Sequence
  Synthetic polypeptide
  MISC_FEATURE (1)..(7): X1 to X7 is repeated 414 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 414 - protein, 7 aa, Artificial Sequence
  Synthetic polypeptide
  MISC_FEATURE (1)..(7): X1 to X7 is repeated 415 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 415 - protein, 7 aa, Artificial Sequence
  Synthetic polypeptide
  MISC_FEATURE (1)..(7): X1 to X7 is repeated 416 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 416 - protein, 7 aa, Artificial Sequence
  Synthetic polypeptide
  MISC_FEATURE (1)..(7): X1 to X7 is repeated 417 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 417 - protein, 7 aa, Artificial Sequence
  Synthetic polypeptide
  MISC_FEATURE (1)..(7): X1 to X7 is repeated 418 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 418 - protein, 7 aa, Artificial Sequence
  Synthetic polypeptide
  MISC_FEATURE (1)..(7): X1 to X7 is repeated 419 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 419 - protein, 7 aa, Artificial Sequence
  Synthetic polypeptide
  MISC_FEATURE (1)..(7): X1 to X7 is repeated 420 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 420 - protein, 7 aa, Artificial Sequence
  Synthetic polypeptide
  MISC_FEATURE (1)..(7): X1 to X7 is repeated 421 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 421 - protein, 7 aa, Artificial Sequence
  Synthetic polypeptide
  MISC_FEATURE (1)..(7): X1 to X7 is repeated 422 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 422 - protein, 7 aa, Artificial Sequence
  Synthetic polypeptide
  MISC_FEATURE (1)..(7): X1 to X7 is repeated 423 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 423 - protein, 7 aa, Artificial Sequence
  Synthetic polypeptide
  MISC_FEATURE (1)..(7): X1 to X7 is repeated 424 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 424 - protein, 7 aa, Artificial Sequence
  Synthetic polypeptide
  MISC_FEATURE (1)..(7): X1 to X7 is repeated 425 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 425 - protein, 7 aa, Artificial Sequence
  Synthetic polypeptide
  MISC_FEATURE (1)..(7): X1 to X7 is repeated 426 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 426 - protein, 7 aa, Artificial Sequence
  Synthetic polypeptide
  MISC_FEATURE (1)..(7): X1 to X7 is repeated 427 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 427 - protein, 7 aa, Artificial Sequence
  Synthetic polypeptide
  MISC_FEATURE (1)..(7): X1 to X7 is repeated 428 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 428 - protein, 7 aa, Artificial Sequence
  Synthetic polypeptide
  MISC_FEATURE (1)..(7): X1 to X7 is repeated 429 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 429 - protein, 7 aa, Artificial Sequence
  Synthetic polypeptide
  MISC_FEATURE (1)..(7): X1 to X7 is repeated 430 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 430 - protein, 7 aa, Artificial Sequence
  Synthetic polypeptide
  MISC_FEATURE (1)..(7): X1 to X7 is repeated 431 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 431 - protein, 7 aa, Artificial Sequence
  Synthetic polypeptide
  MISC_FEATURE (1)..(7): X1 to X7 is repeated 432 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 432 - protein, 7 aa, Artificial Sequence
  Synthetic polypeptide
  MISC_FEATURE (1)..(7): X1 to X7 is repeated 433 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 433 - protein, 7 aa, Artificial Sequence
  Synthetic polypeptide
  MISC_FEATURE (1)..(7): X1 to X7 is repeated 434 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 434 - protein, 7 aa, Artificial Sequence
  Synthetic polypeptide
  MISC_FEATURE (1)..(7): X1 to X7 is repeated 435 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 435 - protein, 7 aa, Artificial Sequence
  Synthetic polypeptide
  MISC_FEATURE (1)..(7): X1 to X7 is repeated 436 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 436 - protein, 7 aa, Artificial Sequence
  Synthetic polypeptide
  MISC_FEATURE (1)..(7): X1 to X7 is repeated 437 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 437 - protein, 7 aa, Artificial Sequence
  Synthetic polypeptide
  MISC_FEATURE (1)..(7): X1 to X7 is repeated 438 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 438 - protein, 7 aa, Artificial Sequence
  Synthetic polypeptide
  MISC_FEATURE (1)..(7): X1 to X7 is repeated 439 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 439 - protein, 7 aa, Artificial Sequence
  Synthetic polypeptide
  MISC_FEATURE (1)..(7): X1 to X7 is repeated 440 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 440 - protein, 7 aa, Artificial Sequence
  Synthetic polypeptide
  MISC_FEATURE (1)..(7): X1 to X7 is repeated 441 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 441 - protein, 7 aa, Artificial Sequence
  Synthetic polypeptide
  MISC_FEATURE (1)..(7): X1 to X7 is repeated 442 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 442 - protein, 7 aa, Artificial Sequence
  Synthetic polypeptide
  MISC_FEATURE (1)..(7): X1 to X7 is repeated 443 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 443 - protein, 7 aa, Artificial Sequence
  Synthetic polypeptide
  MISC_FEATURE (1)..(7): X1 to X7 is repeated 444 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 444 - protein, 7 aa, Artificial Sequence
  Synthetic polypeptide
  MISC_FEATURE (1)..(7): X1 to X7 is repeated 445 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 445 - protein, 7 aa, Artificial Sequence
  Synthetic polypeptide
  MISC_FEATURE (1)..(7): X1 to X7 is repeated 446 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 446 - protein, 7 aa, Artificial Sequence
  Synthetic polypeptide
  MISC_FEATURE (1)..(7): X1 to X7 is repeated 447 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 447 - protein, 7 aa, Artificial Sequence
  Synthetic polypeptide
  MISC_FEATURE (1)..(7): X1 to X7 is repeated 448 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 448 - protein, 7 aa, Artificial Sequence
  Synthetic polypeptide
  MISC_FEATURE (1)..(7): X1 to X7 is repeated 449 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 449 - protein, 7 aa, Artificial Sequence
  Synthetic polypeptide
  MISC_FEATURE (1)..(7): X1 to X7 is repeated 450 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 450 - protein, 7 aa, Artificial Sequence
  Synthetic polypeptide
  MISC_FEATURE (1)..(7): X1 to X7 is repeated 451 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 451 - protein, 7 aa, Artificial Sequence
  Synthetic polypeptide
  MISC_FEATURE (1)..(7): X1 to X7 is repeated 452 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 452 - protein, 7 aa, Artificial Sequence
  Synthetic polypeptide
  MISC_FEATURE (1)..(7): X1 to X7 is repeated 453 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 453 - protein, 7 aa, Artificial Sequence
  Synthetic polypeptide
  MISC_FEATURE (1)..(7): X1 to X7 is repeated 454 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 454 - protein, 7 aa, Artificial Sequence
  Synthetic polypeptide
  MISC_FEATURE (1)..(7): X1 to X7 is repeated 455 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 455 - protein, 7 aa, Artificial Sequence
  Synthetic polypeptide
  MISC_FEATURE (1)..(7): X1 to X7 is repeated 456 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 456 - protein, 7 aa, Artificial Sequence
  Synthetic polypeptide
  MISC_FEATURE (1)..(7): X1 to X7 is repeated 457 times
  MISC_FEATURE (1)..(1): X1 is a hydrophobic amino acid
  MISC_FEATURE (2)..(2): X2 is a polar or charged amino acid
  MISC_FEATURE (3)..(3): X3 is a polar or charged amino acid
  MISC_FEATURE (4)..(4): X4 is a hydrophobic amino acid
  MISC_FEATURE (5)..(5): X5 is a polar or charged amino acid
  MISC_FEATURE (6)..(6): X6 is a polar or charged amino acid
  MISC_FEATURE (7)..(7): X7 is a polar or charged amino acid
XXXXXXX

SEQ ID NO: 457 - protein, 105 aa, Artificial Sequence
  Synthetic polypeptide
  MISC_FEATURE (1)..(1): X1 is a polar amino acid defining an N-terminal residue
  MISC_FEATURE (2)..(2): X2 is a polar residue forming the A bend
  MISC_FEATURE (3)..(3): X3 is a polar or charged residue, which together with X4 and X5 forms a loop
  MISC_FEATURE (3)..(5): X3 to X5 forms a loop
  MISC_FEATURE (4)..(4): X4 is a polar or charged residue, which together with X3 and X5 forms a loop
  MISC_FEATURE (5)..(5): X5 is a polar or charged residue, which together with X3 and X4 forms a loop
  MISC_FEATURE (6)..(6): X6 is polar amino acid, which together with X7 and X8 forms the B bend
  MISC_FEATURE (6)..(8): X6 to X8 forms the B bend
  MISC_FEATURE (7)..(7): X7 is polar amino acid, which together with X6 and X8 forms the B bend
  MISC_FEATURE (8)..(8): X8 is polar amino acid, which together with X6 and X7 forms the B bend
  MISC_FEATURE (9)..(9): X9 is a polar amino acid forming a loop
  MISC_FEATURE (10)..(10): X10 is any amino acid, which together with X11 to X13 form the beta A strand
  STRAND (10)..(13): X10 to X13 form the beta A strand
  MISC_FEATURE (11)..(11): X11 is any amino acid, which together with X10, X12 and X13 form the beta A strand
  MISC_FEATURE (12)..(12): X12 is any amino acid, which together with X10, X11 and X13 form the beta A strand
  MISC_FEATURE (13)..(13): X13 is any amino acid, which together with X10 to X12 form the beta A strand
  MISC_FEATURE (14)..(14): X14 is any amino acid, which together with X15 forms a loop
  MISC_FEATURE (14)..(15): X14 to X15 forms a loop
  MISC_FEATURE (15)..(15): X15 is any amino acid, which together with X14 forms a loop
  MISC_FEATURE (16)..(16): X16 is a polar residue, which together with X17 to X19 forms the C bend
  MISC_FEATURE (16)..(19): X16 to X19 forms the C bend
  MISC_FEATURE (17)..(17): X17 is a polar residue, which together with X16, X18 and X19 forms the C bend
  MISC_FEATURE (18)..(18): X18 is a polar residue, which together with X16, X17 and X19 forms the C bend
  MISC_FEATURE (19)..(19): X19 is a polar residue, which together with X16 to X18 forms the C bend
  MISC_FEATURE (20)..(20): X20 is a polar or non-polar amino acid, which together with X21 and X22 forms a loop
  MISC_FEATURE (20)..(22): X20 to X22 forms a loop
  MISC_FEATURE (21)..(21): X21 is a polar or non-polar amino acid, which together with X20 and X22 forms a loop
  MISC_FEATURE (22)..(22): X22 is a polar or non-polar amino acid, which together with X20 and X21 forms a loop
  MISC_FEATURE (23)..(23): X23 is a polar amino acid, which together with X24 forms the D bend
  MISC_FEATURE (23)..(24): X23 to X24 forms the D bend
  MISC_FEATURE (24)..(24): X24 is a polar amino acid, which together with X23 forms the D bend
  MISC_FEATURE (25)..(25): X25 is a non-polar amino acid forming a loop
  MISC_FEATURE (26)..(26): X26 is a polar or ionic amino acid, which together with X27 forms the E bend
  MISC_FEATURE (26)..(27): X26 to X27 forms the E bend
  MISC_FEATURE (27)..(27): X27 is a polar or ionic amino acid, which together with X26 forms the E bend
  MISC_FEATURE (28)..(28): X28 is a polar or non-polar amino acid, which together with X29 to X30 forms a loop
  MISC_FEATURE (28)..(30): X28 to X30 forms a loop
  MISC_FEATURE (29)..(29): X29 is a polar or non-polar amino acid, which together with X28 and X30 forms a loop
  MISC_FEATURE (30)..(30): X30 is a polar or non-polar amino acid, which together with X28 and X29 forms a loop
  MISC_FEATURE (31)..(31): X31 is a polar, non-polar or ionic amino acid, which together with X32 forms the F bend
  MISC_FEATURE (31)..(32): X31 to X32 forms the F bend
  MISC_FEATURE (32)..(32): X32 is a polar, non-polar or ionic amino acid, which together with X31 forms the F bend
  MISC_FEATURE (33)..(33): X33 is any amino acid forming a loop
  MISC_FEATURE (34)..(34): X34 is a non-polar amino acid, which together with X35, X36 and X37 forms the beta B strand
  STRAND (34)..(37): X34 to X37 forms the beta B strand
  MISC_FEATURE (35)..(35): X35 is a non-polar amino acid, which together with X34, X36 and X37 forms the beta B strand
  MISC_FEATURE (36)..(36): X36 is a non-polar amino acid, which together with X34, X35 and X37 forms the beta B strand
  MISC_FEATURE (37)..(37): X37 is a non-polar amino acid, which together with X34, X35 and X36 forms the beta B strand
  MISC_FEATURE (38)..(38): X38 is any amino acid, which together with X39 forms a loop
  MISC_FEATURE (38)..(39): X38 to X39 forms a loop
  MISC_FEATURE (39)..(39): X39 is any amino acid, which together with X38 forms a loop
  MISC_FEATURE (40)..(40): X40 is any amino acid, which together with X41 forms the G bend
  MISC_FEATURE (40)..(41): X40 to X41 forms the G bend
  MISC_FEATURE (41)..(41): X41 is any amino acid, which together with X40 forms the G bend
  MISC_FEATURE (42)..(42): X42 is any amino acid, which together with X43 and X44 forms a loop
  MISC_FEATURE (42)..(44): X42 to X44 forms a loop
  MISC_FEATURE (43)..(43): X43 is any amino acid, which together with X42 and X44 forms a loop
  MISC_FEATURE (44)..(44): X44 is any amino acid, which together with X42 and X43 forms a loop
  MISC_FEATURE (45)..(45): X45 is any amino acid, which together with X46 forms the A turn
  TURN (45)..(46): X45 to X46 forms the A turn
  MISC_FEATURE (46)..(46): X46 is any amino acid, which together with X45 forms the A turn
  MISC_FEATURE (47)..(47): X47 is a non-polar amino acid forming the H bend
  MISC_FEATURE (48)..(48): X48 is a polar, non-polar, or ionic amino acid, which together with X49, X50, X51 and X52 forms the beta C strand
  STRAND (48)..(52): X48 to X52 forms the beta C strand
  MISC_FEATURE (49)..(49): X49 is a polar, non-polar, or ionic amino acid, which together with X48, X50, X51 and X52 forms the beta C strand
  MISC_FEATURE (50)..(50): X50 is a polar, non-polar, or ionic amino acid, which together with X48, X49, X51 and X52 forms the beta C strand
  MISC_FEATURE (51)..(51): X51 is a polar, non-polar, or ionic amino acid, which together with X48, X49, X50 and X52 forms the beta C strand
  MISC_FEATURE (52)..(52): X52 is a polar, non-polar, or ionic amino acid, which together with X48, X49, X50 and X51 forms the beta C strand
  MISC_FEATURE (53)..(53): X53 is any amino acid forming the I bend
  MISC_FEATURE (54)..(54): X54 is any amino acid, which together with X55 and X56 forms the B turn
  TURN (54)..(56): X54 to X56 forms the B turn
  MISC_FEATURE (55)..(55): X55 is any amino acid, which together with X54 and X56 forms the B turn
  MISC_FEATURE (56)..(56): X56 is any amino acid, which together with X54 and X55 forms the B turn
  MISC_FEATURE (57)..(57): X57 is any amino acid, which together with X58, X59, and X60 forms a loop
  MISC_FEATURE (57)..(60): X57 to X60 forms a loop
  MISC_FEATURE (58)..(58): X58 is any amino acid, which together with X57, X59, and X60 forms a loop
  MISC_FEATURE (59)..(59): X59 is any amino acid, which together with X57, X58, and X60 forms a loop
  MISC_FEATURE (60)..(60): X60 is any amino acid, which together with X57, X58, and X59 forms a loop
  MISC_FEATURE (61)..(61): X61 is any amino acid, which together with X62, X63 and X64 forms the beta D strand
  STRAND (61)..(64): X61 to X64 forms the beta D strand
  MISC_FEATURE (62)..(62): X62 is any amino acid, which together with X61, X63 and X64 forms the beta D strand
  MISC_FEATURE (63)..(63): X63 is any amino acid, which together with X61, X62 and X64 forms the beta D strand
  MISC_FEATURE (64)..(64): X64 is any amino acid, which together with X61, X62 and X63 forms the beta D strand
  MISC_FEATURE (65)..(65): X65 is any amino acid, which together with X66 forms a loop
  MISC_FEATURE (65)..(66): X65 to X66 forms a loop
  MISC_FEATURE (66)..(66): X66 is any amino acid, which together with X65 forms a loop
  MISC_FEATURE (67)..(67): X67 is any amino acid, which together with X68 and X69 forms the J bend
  MISC_FEATURE (67)..(69): X67 to X69 forms the J bend
  MISC_FEATURE (68)..(68): X68 is any amino acid, which together with X67 and X69 forms the J bend
  MISC_FEATURE (69)..(69): X69 is any amino acid, which together with X67 and X68 forms the J bend
  MISC_FEATURE (70)..(70): X70 is any amino acid forming a loop
  MISC_FEATURE (71)..(71): X71 is any amino acid, which together with X72 and X73 forms the beta E strand
  STRAND (71)..(73): X71 to X73 forms the beta E strand
  MISC_FEATURE (72)..(72): X72 is any amino acid, which together with X71 and X73 forms the beta E strand
  MISC_FEATURE (73)..(73): X73 is any amino acid, which together with X71 and X72 forms the beta E strand
  MISC_FEATURE (74)..(74): X74 is any amino acid forming a loop
  MISC_FEATURE (75)..(75): X75 is any amino acid, which together with X76 forms the K bend
  MISC_FEATURE (75)..(76): X75 to X76 forms the K bend
  MISC_FEATURE (76)..(76): X76 is any amino acid, which together with X75 forms the K bend
  MISC_FEATURE (77)..(77): X77 is a polar amino acid, which together with X78 forms the C turn
  TURN (77)..(78): X77 to X78 forms the C turn
  MISC_FEATURE (78)..(78): X78 is a polar amino acid, which together with X77 forms the C turn
  MISC_FEATURE (79)..(79): X79 is a polar amino acid forming the L bend
  MISC_FEATURE (80)..(80): X80 is a polar amino acid, which together with X81 forms a loop
  MISC_FEATURE (80)..(81): X80 to X81 forms a loop
  MISC_FEATURE (81)..(81): X81 is a polar amino acid, which together with X80 forms a loop
  STRAND (82)..(82): X82 is a polar amino acid forming the beta A bridge
  MISC_FEATURE (83)..(83): X83 is a polar amino acid, which together with X84, X85, X86, X87 and X88 forms a loop
  MISC_FEATURE (83)..(88): X83 to X88 forms a loop
  MISC_FEATURE (84)..(84): X84 is a polar amino acid, which together with X83, X85, X86, X87 and X88 forms a loop
  MISC_FEATURE (85)..(85): X85 is a polar amino acid, which together with X83, X84, X86, X87 and X88 forms a loop
  MISC_FEATURE (86)..(86): X86 is a polar amino acid, which together with X83, X84, X85, X87 and X88 forms a loop
  MISC_FEATURE (87)..(87): X87 is a polar amino acid, which together with X83, X84, X85, X86 and X88 forms a loop
  MISC_FEATURE (88)..(88): X88 is a polar amino acid, which together with X83, X84, X85, X86 and X87 forms a loop
  MISC_FEATURE (89)..(89): X89 is a polar or ionic amino acid, which together with X90, X91, X92, X93, X94, X95 and X96 forms the beta F strand
  STRAND (89)..(96): X89 to X96 forms the beta F strand
  MISC_FEATURE (90)..(90): X90 is a polar or ionic amino acid, which together with X89, X91, X92, X93, X94, X95 and X96 forms the beta F strand
  MISC_FEATURE (91)..(91): X91 is a polar or ionic amino acid, which together with X89, X90, X92, X93, X94, X95 and X96 forms the beta F strand
  MISC_FEATURE (92)..(92): X92 is a polar or ionic amino acid, which together with X89, X90, X91, X93, X94, X95 and X96 forms the beta F strand
  MISC_FEATURE (93)..(93): X93 is a polar or ionic amino acid, which together with X89, X90, X91, X92, X94, X95 and X96 forms the beta F strand
  MISC_FEATURE (94)..(94): X94 is a polar or ionic amino acid, which together with X89, X90, X91, X92, X93, X95 and X96 forms the beta F strand
  MISC_FEATURE (95)..(95): X95 is a polar or ionic amino acid, which together with X89, X90, X91, X92, X93, X94 and X96 forms the beta F strand
  MISC_FEATURE (96)..(96): X96 is a polar or ionic amino acid, which together with X89, X90, X91, X92, X93, X94 and X95 forms the beta F strand
  MISC_FEATURE (97)..(97): X97 is a polar or non-polar amino acid, which together with X98, X99 and X100 forms a loop
  MISC_FEATURE (97)..(100): X97 to X100 forms a loop
  MISC_FEATURE (98)..(98): X98 is a polar or non-polar amino acid, which together with X97, X99 and X100 forms a loop
  MISC_FEATURE (99)..(99): X99 is a polar or non-polar amino acid, which together with X97, X98 and X100 forms a loop
  MISC_FEATURE (100)..(100): X100 is a polar or non-polar amino acid, which together with X97, X98 and X99 forms a loop
  MISC_FEATURE (101)..(101): X101 is a polar amino acid, which together with X102 and X103 forms the M bend
  MISC_FEATURE (101)..(103): X101 to X103 forms the M bend
  MISC_FEATURE (102)..(102): X102 is a polar amino acid, which together with X101 and X103 forms the M bend
  MISC_FEATURE (103)..(103): X103 is a polar amino acid, which together with X101 and X102 forms the M bend
  MISC_FEATURE (104)..(104): X104 is a polar or non-polar amino acid, which together with X105 defines a C-terminal segment
  MISC_FEATURE (104)..(105): X104 to X105 defines a C-terminal segment
  MISC_FEATURE (105)..(105): X105 is a polar or non-polar amino acid, which together with X104 defines a C-terminal segment
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 458 - protein, 34 aa, Artificial Sequence
  Exemplary TAL effector motif
LTPEQVVAIASHDGGKQALETVQRLLPVLCQAHG

SEQ ID NO: 459 - protein, 105 aa, Artificial Sequence
  Exemplary globular temperature sensing amino acid sequence
TTKKASDSAFWLEVEGNSMTAPTGSKPSFPDGMLILVDPEQAVEPGDFCIARLGGDEFTFKKLIRDSGQVFLQPLNPQYPMIPCNESCSVVGKVIASQWPEETFG

SEQ ID NO: 460 - DNA, 1116 bp, Salmonella enterica
  CDS (1)..(1116)
atgcgtccggcgacatacgaaccagaacagattattgaagcagggctggccctgcaggctgaaggacggaatatcaccgggttcgcactacgtaaccaggtgggtggcggcaatccgacacgtctccgccagatatgggacgaataccaggcttcacagagcacggtcgtcactgaacccgttgccgagctgccagtggaagtggctgaagaagtgaaggccgtctccgccgcgctgtccgaacgcatcacccagctggcgacagaactgaatgacaaggcggtccgggctgcagaacgccgggttgcggaagtcacgcgtgctgccggtgaacagaccgcacaggcagagcgggagctggccgacgccgcgcagacagtcgacgacctggaagaaaaactggatgaactgcaggacagatatgacagtttgacgctggcgctggagtcagaacgttcactgcgtcagcagcatgatgtggagatggcccagctgaaagagcgtcttgcggccgctgaagagaatacccgtcagcgagaggaacggtatcaggagcagaagacagtgctgcaggatgcgcttaatgcggagcaggcacagcacaaaaacacgcgggaagacctgcagaaacgactggagcaaatttctgccgaagctaatgcgcgtacagaagaactgaagtctgaacgcgataaagtcaatactctccttacccgccttgaatcgcaggaaaatgcgctggcctcagaacgtcagcagcatctggccacccgcgaaacgctgcagcaacgcctcgagcaggccatcgctgacacgcaggcgcgcgccggtgagattgcacttgaacgtgacagagtcagcagcctcaccgcaaggctggaatcgcaggaaaaggcctcctcggagcaactggtgcgtatgggcagtgaaatagccagtctgacagagcgttgcacacagctggaaaaccagcgtgatgatgcccgtctggagacgatgggggagaaagaaacggtcgcggcactgcgtggtgaggctgaagccctgaagcgtcagaaccagtcactgatggcggcgctttcaggcaataaacagaccggtggccagaatgcgtga

SEQ ID NO: 461 - protein, 371 aa, Salmonella enterica
MRPATYEPEQIIEAGLALQAEGRNITGFALRNQVGGGNPTRLRQIWDEYQASQSTVVTEPVAELPVEVAEEVKAVSAALSERITQLATELNDKAVRAAERRVAEVTRAAGEQTAQAERELADAAQTVDDLEEKLDELQDRYDSLTLALESERSLRQQHDVEMAQLKERLAAAEENTRQREERYQEQKTVLQDALNAEQAQHKNTREDLQKRLEQISAEANARTEELKSERDKVNTLLTRLESQENALASERQQHLATRETLQQRLEQAIADTQARAGEIALERDRVSSLTARLESQEKASSEQLVRMGSEIASLTERCTQLENQRDDARLETMGEKETVAALRGEAEALKRQNQSLMAALSGNKQTGGQNA

SEQ ID NO: 462 - DNA, 1116 bp, Artificial Sequence
  TlpA36 polynucleotide
  CDS (1)..(1116)
atgcgtccggcgacatacgaaccagaacagattattgaagcagggctggccctgcaggctgaaggacggaatatcaccgggttcgcactacgtaaccaggtgggtggcggcaatccgacacgtctccgccagatatgggacgaataccaggcttcacagagcacggtcgtcactgaactcgttgccgagctgccagtggaagtggctgaagaagtgaaggccgtctccgccgcgctgtccgaacgcatcacccagctggcgacagaactgaatgacaaggcggtccgggctgcagaacgccgggttgcggaagtcacgcgtgctgccggtgaacagaccgcacaggcagagcgggagctggccgacgccgcgcagacagtcgacgacctggaagaaaaactggttgaactgcaggacagatatgacagtttgacgctggcgctggagtcagaacgttcactgcgtcagcagcatgatgtggagatggcccagctgaaagagcgtcttgcggccgctgaagagaatacccgtcagcgagaggaacggtatcaggagcagaggacagtgctgcaggatgcgcttaatgcggagcaggcacagcacataaacacgcgggaagaccagcagaaacgactggagcaaatttctgccgaagctaatgcgcgtacagaagaactgaagtctgaacgcgataaagtcaatactctccttacccgccttgaatcgcaggaaaatgcgctggcctcagaacgtcagcagcatctggccacccgcgaaacgctgcagcaacgcctcgagcaggccatcgctgacacgcaggcgcgcgccggtgagattgcacttgaacgtgacagagtcagcagcctcaccgcaaggctggaatcgcaggaaaaggcctcctcggagcaactggtgcgtatgggcagtgaaatagccagtctgacagagcgttgcacacagctggaaaaccagcgtgatgatgcccgtctggagacgatgggggagaaagaaacggtcgcggcactgcgtggtgaggctgaagccctgaagcgtcagaaccagtcactgatggcggcgctttcaggcaataaacagaccggtggccagaatgcgtga

SEQ ID NO: 463 - protein, 371 aa, Artificial Sequence
  Synthetic Construct
MRPATYEPEQIIEAGLALQAEGRNITGFALRNQVGGGNPTRLRQIWDEYQASQSTVVTELVAELPVEVAEEVKAVSAALSERITQLATELNDKAVRAAERRVAEVTRAAGEQTAQAERELADAAQTVDDLEEKLVELQDRYDSLTLALESERSLRQQHDVEMAQLKERLAAAEENTRQREERYQEQRTVLQDALNAEQAQHINTREDQQKRLEQISAEANARTEELKSERDKVNTLLTRLESQENALASERQQHLATRETLQQRLEQAIADTQARAGEIALERDRVSSLTARLESQEKASSEQLVRMGSEIASLTERCTQLENQRDDARLETMGEKETVAALRGEAEALKRQNQSLMAALSGNKQTGGQNA

SEQ ID NO: 464 - DNA, 1116 bp, Artificial Sequence
  TlpA39  polynucleotide
  CDS (1)..(1116)
atgcgtccggcgacatacgaaccagaacagattattgaagcagggctggccctgcaggctgaaggacggaatatcaccgggttcgcactacgtaaccaggtgggtggcggcaatccgacacgtctccgccagatatgggacgaataccaggcttcacagagcacggtcgtcactgaacccgttgccgagctgccagtggaagtggctgaagaagtgaaggccgtctccgccgcgctgtccgaacgcatcacccagctggcgacagaactgaatgacaaggcggtccgggctgcagaacgccgggttgcggaagtcacgcgtgctgccggtgaacagaccgcacaggcagagcgggagctggccgacgccgcgcagacagtcgacgacctggaagaaaaactggttgaactgcaggacagatatgacagtttgacgctggcgctggagtcagaacgttcactgcgtcagcagcatgatgtggagatggcccagctgaaagagcgtcttgcggccgctgaagagaatacccgtcagcgagaggaacggtatcaggagcagaagacagtgctgcaggatgcgcttaatgcggagcaggcacagcacaaaaacacgcgggaagacctgcagaaacgactggagcaaatttctgtcgaagctaatgcgcgtacagaagaactgaagtctgaacgcgataaagtcaatactttccttacccgccttgaatcgcaggaaaatgcgctggcctcagaacgtcagcagcatctggccacccgcgaaacgctgcagcaacgcctcgagcaggccatcgctgacacgcaggcgcgcgccggtgagattgcacttgaacgtgacagagtcagcagcctcaccgcaaggctggaatcgcaggaaaaggcctcctcggagcaactggtgcgtatgggcagtgaaatagccagtctgacagagcgttgcacacagctggaaaaccagcgtgatgatgcccgtctggagacgatgggggagaaagaaacggtcgcggcactgcgtggtgaggctgaagccctgaagcgtcagaaccagtcactgatggcggcgctttcaggcaataaacagaccggtggccagaatgcgtga

SEQ ID NO: 465 - protein, 371 aa, Artificial Sequence
  Synthetic Construct
MRPATYEPEQIIEAGLALQAEGRNITGFALRNQVGGGNPTRLRQIWDEYQASQSTVVTEPVAELPVEVAEEVKAVSAALSERITQLATELNDKAVRAAERRVAEVTRAAGEQTAQAERELADAAQTVDDLEEKLVELQDRYDSLTLALESERSLRQQHDVEMAQLKERLAAAEENTRQREERYQEQKTVLQDALNAEQAQHKNTREDLQKRLEQISVEANARTEELKSERDKVNTFLTRLESQENALASERQQHLATRETLQQRLEQAIADTQARAGEIALERDRVSSLTARLESQEKASSEQLVRMGSEIASLTERCTQLENQRDDARLETMGEKETVAALRGEAEALKRQNQSLMAALSGNKQTGGQNA

SEQ ID NO: 466 - DNA, 714 bp, Escherichia coli
  CDS (1)..(714)
atgagcacaaaaaagaaaccattaacacaagagcagcttgaggacgcacgtcgccttaaagcaatttatgaaaaaaagaaaaatgaacttggcttatcccaggaatctgtcgcagacaagatggggatggggcagtcaggcgttggtgctttatttaatggcatcaatgcattaaatgcttataacgccgcattgcttacaaaaattctcaaagttagcgttgaagaatttagcccttcaatcgccagagaaatctacgagatgtatgaagcggttagtatgcagccgtcacttagaagtgagtatgagtaccctgttttttctcatgttcaggcagggatgttctcacctgagcttagaacctttaccaaaggtgatgcggagagatgggtaagcacaaccaaaaaagccagtgattctgcattctggcttgaggttgaaggtaattccatgaccgcaccaacaggctccaagccaagctttcctgacggaatgttaattctcgttgaccctgagcaggctgttgagccaggtgatttctgcatagccagacttgggggtgatgagtttaccttcaagaaactgatcagggatagcggtcaggtgtttttacaaccactaaacccacagtacccaatgatcccatgcaatgagagttgttccgttgtggggaaagttatcgctagtcagtggcctgaagagacgtttggctga

SEQ ID NO: 467 - protein, 237 aa, Escherichia coli
MSTKKKPLTQEQLEDARRLKAIYEKKKNELGLSQESVADKMGMGQSGVGALFNGINALNAYNAALLTKILKVSVEEFSPSIAREIYEMYEAVSMQPSLRSEYEYPVFSHVQAGMFSPELRTFTKGDAERWVSTTKKASDSAFWLEVEGNSMTAPTGSKPSFPDGMLILVDPEQAVEPGDFCIARLGGDEFTFKKLIRDSGQVFLQPLNPQYPMIPCNESCSVVGKVIASQWPEETFG

SEQ ID NO: 468 - DNA, 714 bp, Artificial Sequence
  TcI38 polynucleotide
  CDS (1)..(714)
gtgagcacaaaaaagaaaccattaacacaagagcagcttgaggacgcacgtcgccttaaagcaatttatgaaaaaaagaaaaatgaacttggcttatcccaggaatctgtcgcagacaagatggggatggggcagtcaggcgttggtgccttatttaatggcatcaatgcattaaatgcttataacgccgcatcgcttacaagaattctcaaagttagcgttgaagaatttagcccttcaatcgccagagaaatctacgagatgtatgaagcggttagtatgcagccgtcacttagaagtgagtatgagtaccctgttttttctcatgttcaggcagggatgctctcacctgagcttagaacctttaccaaaggtggtgcggaaaggtgggtaagcacaaccaaaaaagccagtgattctgcattctggcttgaggttgaaggtaattccatgacagcaccaacaggctccaagccaagctttcctgacggaatgttaattctcgttgaccctgagcaggctgttgagccaggtgatttctgcatagccagactcgggggtggtgagtttaccttcaagaaactgatcagggatagcggtcaggtgtttttacaaccactaaacccacagtacccaatgatcccatgcaatgagagttgttccgttgtggggaaagttatcgctagtcagtggcctgaagagacgtttggctga

SEQ ID NO: 469 - protein, 237 aa, Artificial Sequence
  Synthetic Construct
VSTKKKPLTQEQLEDARRLKAIYEKKKNELGLSQESVADKMGMGQSGVGALFNGINALNAYNAASLTRILKVSVEEFSPSIAREIYEMYEAVSMQPSLRSEYEYPVFSHVQAGMLSPELRTFTKGGAERWVSTTKKASDSAFWLEVEGNSMTAPTGSKPSFPDGMLILVDPEQAVEPGDFCIARLGGGEFTFKKLIRDSGQVFLQPLNPQYPMIPCNESCSVVGKVIASQWPEETFG

SEQ ID NO: 470 - DNA, 714 bp, Artificial Sequence
  TcI42 polynucleotide
  CDS (1)..(714)
atgagcacaaaaaagaatccattaacacaagagcagcttgaggacgcacgtcgccttaaagcaatttatgaaaaaaagaaaaatgaacttggcttaacccaggaatctgtcgcagacaagatggggatggggcagtcaggcgttggtgctctatttaatggcatcaatgcattaaatgctcataacgccgcattgcttacaaaaattctcaaagttagcgttgaagaatttagcccttcaatcgccagagaaatctacgagatgtatgaagcggttagtatgcagccgtcacttagaagtgagtatgagtaccctgttttttctcatgttcaggcagggatgttctcacctgagcctagaacctgtaccaaaggtgatgcggagagatgggtaagcacaaccaaaaaagccagtgattctgcattctggcttgaggttgaaggtaattccatgaccgcaccaacaggctccaagccaagctttcctgacggaatgttaattctcgttgaccctgagcaggctgttgagccaggtgatttctgcatagccagacttgggggtgatgagtttaccttcaagaaactgatcagggatagcggtcaggtgtttttacaaccactaaacccacagtacccaatgatcccatgcaatgagagttgttccgttgtggggaaagttatcgctagtcagtggcctgaagagacgtttggctga

SEQ ID NO: 471 - protein, 237 aa, Artificial Sequence
  Synthetic Construct
MSTKKNPLTQEQLEDARRLKAIYEKKKNELGLTQESVADKMGMGQSGVGALFNGINALNAHNAALLTKILKVSVEEFSPSIAREIYEMYEAVSMQPSLRSEYEYPVFSHVQAGMFSPEPRTCTKGDAERWVSTTKKASDSAFWLEVEGNSMTAPTGSKPSFPDGMLILVDPEQAVEPGDFCIARLGGDEFTFKKLIRDSGQVFLQPLNPQYPMIPCNESCSVVGKVIASQWPEETFG

SEQ ID NO: 472 - protein, 69 aa, Artificial Sequence
  TlpA DNA binding domain
MRPATYEPEQIIEAGLALQAEGRNITGFALRNQVGGGNPTRLRQIWDEYQASQSTVVTEPVAELPVEVA

SEQ ID NO: 473 - protein, 23 aa, Artificial Sequence
  TlpA Heptad repeat A
EEVKAVSAALSERITQLATELND

SEQ ID NO: 474 - protein, 16 aa, Artificial Sequence
  TlpA Heptad repeat B
KAVRAAERRVAEVTRA

SEQ ID NO: 475 - protein, 44 aa, Artificial Sequence
  TlpA Heptad repeat C
AGEQTAQAERELADAAQTVDDLEEKLDELQDRYDSLTLALESER

SEQ ID NO: 476 - protein, 24 aa, Artificial Sequence
  TlpA Heptad repeat D
RQQHDVEMAQLKERLAAAEENTRQ

SEQ ID NO: 477 - protein, 14 aa, Artificial Sequence
  TlpA Heptad repeat E
EERYQEQKTVLQDA

SEQ ID NO: 478 - protein, 5 aa, Artificial Sequence
  TlpA Heptad repeat F
LNAEQ

SEQ ID NO: 479 - protein, 23 aa, Artificial Sequence
  TlpA Heptad repeat G
AQHKNTREDLQKRLEQISAEANA

SEQ ID NO: 480 - protein, 10 aa, Artificial Sequence
  TlpA Heptad repeat H
TEELKSERDK

SEQ ID NO: 481 - protein, 4 aa, Artificial Sequence
  TlpA Heptad repeat I
VNTL

SEQ ID NO: 482 - protein, 16 aa, Artificial Sequence
  TlpA Heptad repeat J
TRLESQENALASERQQ

SEQ ID NO: 483 - protein, 9 aa, Artificial Sequence
  TlpA Heptad repeat K
HLATRETLQ

SEQ ID NO: 484 - protein, 16 aa, Artificial Sequence
  TlpA Heptad repeat L
QRLEQAIADTQARAGE

SEQ ID NO: 485 - protein, 30 aa, Artificial Sequence
  Amino acids between TlpA Heptad repeats L and M
IALERDRVSSLTARLESQEKASSEQLVRMG

SEQ ID NO: 486 - protein, 52 aa, Artificial Sequence
  TlpA Heptad repeat M
SEIASLTERCTQLENQRDDARLETMGEKETVAALRGEAEALKRQNQSLMAAL

SEQ ID NO: 487 - protein, 11 aa, Artificial Sequence
  Amino acids after TlpA Heptad repeat M
SGNKQTGGQNA

SEQ ID NO: 488 - protein, 139 aa, Artificial Sequence
  Residues 1 to 139 of TlpA
MRPATYEPEQIIEAGLALQAEGRNITGFALRNQVGGGNPTRLRQIWDEYQASQSTVVTEPVAELPVEVAEEVKAVSAALSERITQLATELNDKAVRAAERRVAEVTRAAGEQTAQAERELADAAQTVDDLEEKLDELQD

The invention claimed is:

1. A genetically engineered temperature sensitive genetic circuit to be operated in a target environment at at least two target temperatures, the temperature sensitive genetic circuit comprising:
   a first temperature sensitive genetic molecular component and a second temperature sensitive molecular component, the first and second temperature sensitive molecular components connected to one or more molecular components by biochemical reactions to form the genetic circuit,
   the first temperature sensitive genetic molecular component comprising a first temperature sensitive transcription factor having, in the target environment, a first bioswitch temperature $Tbs_1$ equal to one of the at least two target temperatures, and
   the second temperature sensitive genetic molecular component comprising a second temperature sensitive transcription factor having, in the target environment, a second bioswitch temperature $Tbs_2$ equal to another one of the at least two target temperatures, and
   wherein the first temperature sensitive transcription factor is different from the second temperature sensitive transcription factor and the first bioswitch temperature $Tbs_1$ is different from the second bioswitch temperature $Tbs_2$,
   wherein the first and second temperature sensitive genetic molecular components are configured to activate or inhibit another molecular component of the genetic circuit at the bioswitch temperature $Tbs_1$ and $Tbs_2$ of the first and second temperature sensitive transcription factors,
   wherein the first and second temperature sensitive transcription factors are selected from the group consisting of a TIpA having SEQ ID NO: 461, a TIpA variant having SEQ ID NO: 463, a TIpA variant having SEQ ID NO: 465, a TcI having SEQ ID NO: 467, a TcI variant having SEQ ID NO: 469, and a TcI variant having SEQ ID NO: 471.

2. The temperature sensitive genetic circuit of claim 1, wherein the first bioswitch temperature $Tbs_1$ and the second bioswitch temperature $Tbs_2$ are selected from 32° C. to 46° C., and the target environment is a bacterial cell or a eukaryotic cell.

3. The temperature sensitive genetic circuit of claim 2, wherein the first bioswitch temperature $Tbs_1$ is selected from 36° C. to 38° C. or from 38° C. to 40° C., and the second bioswitch temperature $Tbs_2$ is selected from 38° C. to 40° C. or from 40° C. to 42° C.

4. The temperature sensitive genetic circuit of claim 1, wherein the temperature sensitive genetic molecular component comprises:
   the first temperature sensitive genetic molecular component configured to activate a first another molecular component of the genetic circuit at the first bioswitch temperature $Tbs_1$ and
   the second temperature sensitive genetic molecular component configured to inhibit the first temperature sensitive molecular component and/or the first another molecular component and to activate or inhibit a second another molecular component of the genetic circuit at the second bioswitch temperature $Tbs_2$,
      the first temperature sensitive genetic molecular component and the second temperature sensitive genetic molecular component forming a temperature sensitive bandpass filter, and
      wherein the first another molecular component is different from the second another molecular component, and the at least two target temperatures form a target temperature range.

5. The temperature sensitive genetic circuit of claim 4, wherein the first bioswitch temperature $Tbs_1$ and the second bioswitch temperature $Tbs_2$ are selected from 32° C. to 46° C., and the target environment is a bacterial cell or a eukaryotic cell.

6. The temperature sensitive genetic circuit of claim 4, wherein the first bioswitch temperature $Tbs_1$ and the second bioswitch temperature $Tbs_2$ are selected from 36° C. to 42° C., and the target environment is a bacterial cell or a eukaryotic cell.

7. The temperature sensitive genetic circuit of claim 4, wherein the first bioswitch temperature $Tbs_1$ is selected from 36° C. to 38° C. or from 38° C. to 40° C., and the second bioswitch temperature $Tbs_2$ is selected from 38° C. to 40° C. or from 40° C. to 42° C.

8. The temperature sensitive genetic circuit of claim 4 wherein the first temperature sensitive transcription factor is the TIpA having SEQ ID NO: 461 or the TIpA variant having SEQ ID NO: 463 or the TIpA variant having SEQ ID NO: 465.

9. The temperature sensitive genetic circuit of claim 4, wherein the second temperature sensitive transcription factor is the TcI having SEQ ID NO: 467 or the TcI variant having SEQ ID NO: 469 or the TcI variant having SEQ ID NO: 471.

10. An isolated temperature sensitive cell to be operated in a target environment at at least two target temperatures, the temperature sensitive cell comprising a genetically engineered temperature sensitive genetic circuit of claim 4.

11. A method to control a biological process in an individual, the method comprising administering to the individual one or more temperature sensitive cells of claim 10, the temperature sensitive cell comprising a temperature sensitive genetic circuit configured to provide an output interfering with the biological process in the individual at a set target temperature between ranging from 34° C. and 44° C.

12. An isolated temperature-sensitive therapeutic cell comprising a genetically engineered temperature sensitive genetic circuit of claim 4, the genetically engineered temperature sensitive genetic circuit comprising at least one therapeutic molecular component, wherein at least one temperature sensitive genetic molecular component is configured to activate or inhibit the at least one therapeutic molecular component at a therapeutic bioswitch temperature $Tbs_T$.

13. A method to treat a condition in an individual, the method comprising administering to the individual one or more therapeutic temperature sensitive cells of claim 12 comprising a temperature sensitive genetic circuit configured to provide a therapeutic output for the condition in the individual at a set target temperature ranging from 34° C. and 44° C.

14. A method to activate a therapeutic gene by applying thermal energy, the method comprising
   providing a temperature-sensitive therapeutic cell of claim 12 having a therapeutic bioswitch temperature $Tbs_T$ and wherein the therapeutic gene is under control of at least one temperature sensitive molecular component having a $Tbs=Tbs_T$, and
   applying to the temperature-sensitive therapeutic cell the therapeutic bioswitch temperature $Tbs_T$ for a time and under conditions to allow activation of the therapeutic gene by the at least one temperature sensitive molecular component.

15. An isolated temperature sensitive inactivable cell comprising a genetically engineered temperature sensitive genetic circuit of claim 4, in which at least one temperature sensitive genetic molecular component is configured to activate or inhibit at least one killer molecular component at an inactivating bioswitch temperature $Tbs_I$.

16. The isolated temperature sensitive inactivable cell of claim 15, wherein in the temperature sensitive genetic circuit the inactivating bioswitch temperature $Tbs_I$ is achieved in response to a decrease in the cell temperature associated with a spatial translocation of the temperature sensitive inactivable cell.

17. A method to control cell viability in a temperature sensitive manner, the method comprising
providing a temperature sensitive cell comprising one or more genetically engineered temperature sensitive genetic circuits of claim 4 comprising at least one temperature sensitive molecular component configured to activate at least one killer molecular component at an inactivating bioswitch temperature equal to $Tbs_I$, and
applying to the temperature sensitive cell the inactivating bioswitch temperature $Tbs_1$ for a time and under conditions to allow activation of the at least one killer molecular component by the at least one temperature sensitive molecular component and to result in death of the temperature sensitive cell.

18. The temperature sensitive genetic circuit of claim 1 wherein the first temperature sensitive transcription factor is the TlpA having SEQ ID NO: 461.

19. The temperature sensitive genetic circuit of claim 1 wherein the first temperature sensitive transcription factor is the TlpA variant having SEQ ID NO: 463.

20. The temperature sensitive genetic circuit of claim 1 wherein the first temperature sensitive transcription factor is the TlpA variant having SEQ ID NO: 465.

21. The temperature sensitive genetic circuit of claim 1, wherein the second temperature sensitive transcription factor is the TcI having SEQ ID NO: 467.

22. The temperature sensitive genetic circuit of claim 1, wherein the second temperature sensitive transcription factor is the TcI variant having SEQ ID NO: 469.

23. The temperature sensitive genetic circuit of claim 1, wherein the second temperature sensitive transcription factor is the TcI variant having SEQ ID NO: 471.

24. An isolated temperature sensitive cell to be operated in a target environment at at least two target temperatures, the temperature sensitive cell comprising a genetically engineered temperature sensitive genetic circuit of claim 1.

25. A method to control a biological process in an individual, the method comprising administering to the individual one or more temperature sensitive cells of claim 24, the temperature sensitive cell comprising a temperature sensitive genetic circuit configured to provide an output interfering with the biological process in the individual at a set target temperature between 34° C. and 44° C.

26. The isolated temperature sensitive cell of claim 24, wherein the cell is a cell of a unicellular eukaryote, an isolated cell from a multicellular eukaryote or a cell within a plant, a fungus or a *Mus musculus*.

27. An isolated temperature-sensitive therapeutic cell comprising a genetically engineered temperature sensitive genetic circuit of claim 1, the genetically engineered temperature sensitive genetic circuit comprising at least one therapeutic molecular component, wherein at least one temperature sensitive genetic molecular component is configured to activate or inhibit the at least one therapeutic molecular component at a therapeutic bioswitch temperature $Tbs_T$.

28. The isolated temperature-sensitive therapeutic cell of claim 27, wherein the cell is a cell of a unicellular eukaryote, an isolated cell from a multicellular eukaryote or a cell within a plant, a fungus or a *Mus musculus*.

29. A method to treat a condition in an individual, the method comprising administering to the individual one or more therapeutic temperature sensitive cells of claim 27 comprising a temperature sensitive genetic circuit configured to provide a therapeutic output for the condition in the individual at a set target temperature between 34° C. and 44° C.

30. A method to activate a therapeutic gene by applying thermal energy, the method comprising
providing a temperature-sensitive therapeutic cell of claim 27 having a therapeutic bioswitch temperature $Tbs_T$ and wherein the therapeutic gene is under control of at least one temperature sensitive molecular component having a $Tbs=Tbs_T$, and
applying to the temperature-sensitive therapeutic cell the therapeutic bioswitch temperature $Tbs_T$ for a time and under conditions to allow activation of the therapeutic gene by the at least one temperature sensitive molecular component.

31. An isolated temperature sensitive inactivable cell comprising a genetically engineered temperature sensitive genetic circuit of claim 1, in which at least one temperature sensitive genetic molecular component is configured to activate or inhibit at least one killer molecular component at an inactivating bioswitch temperature $Tbs_I$.

32. The isolated temperature sensitive inactivable cell of claim 31, wherein the cell is a cell of a unicellular eukaryote, an isolated cell from a multicellular eukaryote or a cell within a plant, a fungus or a *Mus musculus*.

33. The isolated temperature sensitive inactivable cell of claim 31, wherein in the temperature sensitive genetic circuit the inactivating bioswitch temperature $Tbs_I$ is achieved in response to a decrease in the cell temperature associated with a spatial translocation of the temperature sensitive inactivable cell.

34. A method to control cell viability in a temperature sensitive manner, the method comprising
providing a temperature sensitive cell comprising one or more genetically engineered temperature sensitive genetic circuits of claim 1 comprising at least one temperature sensitive molecular component configured to activate at least one killer molecular component at an inactivating bioswitch temperature equal to $Tbs_I$, and
applying to the temperature sensitive cell the inactivating bioswitch temperature $Tbs_1$ for a time and under conditions to allow activation of the at least one killer molecular component by the at least one temperature sensitive molecular component and to result in death of the temperature sensitive cell.

35. The temperature sensitive genetic circuit of claim 1, wherein the first temperature sensitive transcription factor is selected from TlpA of SEQ ID NO: 461, a TlpA variant having SEQ ID NO: 463 and a TlpA variant having SEQ ID NO: 465 and the second temperature sensitive transcription factor is selected from TcI of SEQ ID NO: 467, a TcI variant having SEQ ID NO: 469 and a TcI variant having SEQ ID NO: 471.

36. The temperature sensitive genetic circuit of claim 1, wherein the first bioswitch temperature $Tbs_1$ and the second bioswitch temperature Tbs$_2$ are selected from 36° C. to 42° C., and the target environment is a bacterial cell or a eukaryotic cell.

37. A genetically engineered temperature sensitive genetic circuit to be operated in a target environment at at least two target temperatures, the temperature sensitive genetic circuit comprising:
at least one temperature sensitive genetic molecular component connected to one or more molecular components by biochemical reactions to form the genetic circuit,
the at least one temperature sensitive genetic molecular component comprising a genetically engineered coiled coil temperature sensitive transcription factor having, in the target environment, a bioswitch temperature Tbs equal to one of the at least two target temperatures, and
wherein the at least one temperature sensitive genetic molecular component is configured to activate or inhibit another molecular component of the genetic circuit at the bioswitch temperature Tbs of the genetically engineered coiled coil temperature sensitive transcription factor,
wherein the genetically engineered coiled coil temperature sensitive transcription factor comprises a TlpA variant having SEQ ID NO: 463 or SEQ ID NO: 465.

38. The genetically engineered temperature sensitive genetic circuit of claim 37, wherein TlpA variant has SEQ ID NO: 463.

39. The genetically engineered temperature sensitive genetic circuit of claim 37, the TlpA variant has SEQ ID NO: 465.

40. An isolated temperature sensitive cell to be operated in a target environment at at least two target temperatures, the temperature sensitive cell comprising a genetically engineered temperature sensitive genetic circuit of claim 37.

41. An isolated temperature-sensitive therapeutic cell comprising a genetically engineered temperature sensitive genetic circuit of claim 37, the genetically engineered temperature sensitive genetic circuit further comprising at least one therapeutic molecular component, wherein at least one temperature sensitive genetic molecular component is configured to activate or inhibit the at least one therapeutic molecular component at a therapeutic bioswitch temperature Tbs$_T$.

42. An isolated temperature sensitive inactivable cell comprising a genetically engineered_temperature sensitive genetic circuit of claim 37, the genetically engineered temperature sensitive genetic circuit further comprising at least one killer molecular component, wherein at least one temperature sensitive genetic molecular component is configured to activate or inhibit the at least one killer molecular component at an inactivating bioswitch temperature Tbs$_I$.

43. A method to control a biological process in an individual, the method comprising administering to the individual one or more temperature sensitive cells of claim 40, the temperature sensitive cell comprising a temperature sensitive genetic circuit configured to provide an output interfering with the biological process in the individual at a set target temperature between 34° C. and 44° C.

44. A method to treat a condition in an individual, the method comprising administering to the individual one or more therapeutic temperature sensitive cells of claim 41 comprising a temperature sensitive genetic circuit configured to provide a therapeutic output for the condition in the individual at a set target temperature between 34° C. and 44° C.

45. A method to control cell viability in a temperature sensitive manner, the method comprising
providing a temperature sensitive cell comprising one or more genetically engineered temperature sensitive genetic circuits of claim 37 comprising at least one temperature sensitive molecular component configured to activate at least one killer molecular component at an inactivating bioswitch temperature equal to Tbs$_I$, and
applying to the temperature sensitive cell the inactivating bioswitch temperature Tbs$_I$ for a time and under conditions to allow activation of the at least one killer molecular component by the at least one temperature sensitive molecular component and to result in death of the temperature sensitive cell.

46. A method to activate a therapeutic gene by applying thermal energy, the method comprising
providing a temperature-sensitive therapeutic cell of claim 41 having a therapeutic bioswitch temperature Tbs$_T$ and wherein the therapeutic gene is under control of at least one temperature sensitive molecular component having a Tbs=Tbs$_T$, and
applying to the temperature-sensitive therapeutic cell the therapeutic bioswitch temperature Tbs$_T$ for a time and under conditions to allow activation of the therapeutic gene by the at least one temperature sensitive molecular component.

47. A genetically engineered temperature sensitive genetic circuit to be operated in a target environment at at least two target temperatures, the temperature sensitive genetic circuit comprising:
at least one temperature sensitive genetic molecular component connected to one or more molecular components by biochemical reactions to form the genetic circuit,
the at least one temperature sensitive genetic molecular component comprising a genetically engineered globular temperature sensitive transcription factor having, in the target environment, a bioswitch temperature Tbs equal to one of the at least two target temperatures, and
wherein the at least one temperature sensitive genetic molecular component is configured to activate or inhibit another molecular component of the genetic circuit at the bioswitch temperature Tbs of the genetically engineered globular temperature sensitive transcription factor,
wherein the genetically engineered globular temperature sensitive transcription factor comprises a TcI variant having SEQ ID NO: 469 or SEQ ID NO: 471.

48. The genetically engineered temperature sensitive genetic circuit of claim 47, wherein the TcI variant has SEQ ID NO: 469 and a Tm of about 38° C.

49. The genetically engineered temperature sensitive genetic circuit of claim 47, wherein the TcI variant has SEQ ID NO: 471 and a Tm of about 42° C.

50. An isolated temperature sensitive cell to be operated in a target environment at at least two target temperatures, the temperature sensitive cell comprising a genetically engineered temperature sensitive genetic circuit of claim 47.

51. An isolated temperature-sensitive therapeutic cell comprising a genetically engineered temperature sensitive genetic circuit of claim 47, the genetically engineered temperature sensitive genetic circuit further comprising at least one therapeutic molecular component, wherein at least one temperature sensitive genetic molecular component is configured to activate or inhibit the at least one therapeutic molecular component at a therapeutic bioswitch temperature Tbs$_T$.

52. An isolated temperature sensitive inactivable cell comprising a genetically engineered temperature sensitive genetic circuit of claim 47, the genetically engineered temperature sensitive genetic circuit further comprising at least one killer molecular component, wherein at least one temperature sensitive genetic molecular component is configured to activate or inhibit the at least one killer molecular component at an inactivating bioswitch temperature $Tbs_I$.

53. A method to control a biological process in an individual, the method comprising administering to the individual one or more temperature sensitive cells of claim 50, the temperature sensitive cell comprising a temperature sensitive genetic circuit configured to provide an output interfering with the biological process in the individual at a set target temperature between 34° C. and 44° C.

54. A method to treat a condition in an individual, the method comprising administering to the individual one or more therapeutic temperature sensitive cells of claim 51 comprising a temperature sensitive genetic circuit configured to provide a therapeutic output for the condition in the individual at a set target temperature between 34° C. and 44° C.

55. A method to control cell viability in a temperature sensitive manner, the method comprising providing a temperature sensitive cell comprising one or more genetically engineered temperature sensitive genetic circuits of claim 47 comprising at least one temperature sensitive molecular component configured to activate at least one killer molecular component at an inactivating bioswitch temperature equal to $Tbs_I$, and applying to the temperature sensitive cell the inactivating bioswitch temperature $Tbs_I$ for a time and under conditions to allow activation of the at least one killer molecular component by the at least one temperature sensitive molecular component and to result in death of the temperature sensitive cell.

56. A method to activate a therapeutic gene by applying thermal energy, the method comprising providing a temperature-sensitive therapeutic cell of claim 51 having a therapeutic bioswitch temperature $Tbs_T$ and wherein the therapeutic gene is under control of at least one temperature sensitive molecular component having a $Tbs=Tbs_T$, and applying to the temperature-sensitive therapeutic cell the therapeutic bioswitch temperature $Tbs_T$ for a time and under conditions to allow activation of the therapeutic gene by the at least one temperature sensitive molecular component.

* * * * *